(12) United States Patent
Knoll et al.

(10) Patent No.: US 6,828,097 B1
(45) Date of Patent: Dec. 7, 2004

(54) SINGLE COPY GENOMIC HYBRIDIZATION PROBES AND METHOD OF GENERATING SAME

(75) Inventors: Joan H. M. Knoll, Overland Park, KS (US); Peter K. Rogan, Overland Park, KS (US)

(73) Assignee: The Childrens Mercy Hospital, Kansas City, MO (US)

( * ) Notice: Subject to any disclaimer, the term of this patent is extended or adjusted under 35 U.S.C. 154(b) by 0 days.

(21) Appl. No.: 09/573,080

(22) Filed: May 16, 2000

(51) Int. Cl.[7] .......................... C12Q 1/68; C07H 21/02; C07H 21/04
(52) U.S. Cl. ...................... 435/6; 536/24.3; 536/24.31; 536/24.32; 536/23.1; 536/25.4; 435/91.2
(58) Field of Search ............................. 435/6; 536/24.3, 536/24.31, 24.32, 23.1, 25.4

(56) References Cited

U.S. PATENT DOCUMENTS

| | | | | |
|---|---|---|---|---|
| 5,447,841 A | | 9/1995 | Gray et al. .................... | 435/6 |
| 5,721,098 A | * | 2/1998 | Pinkel et al. .................. | 435/6 |
| 5,756,696 A | | 5/1998 | Gray et al. .................... | 435/6 |
| 5,811,231 A | * | 9/1998 | Farr et al. ..................... | 435/6 |
| 6,040,140 A | * | 3/2000 | Croce et al. ................... | 435/6 |
| 6,222,029 B1 | * | 4/2001 | Edwards et al. ............... | 536/24 |

OTHER PUBLICATIONS

DeRisi et al. Nature Genetics. Dec. 1996. 14: 457–460.*
Sakuma, GenBank Accession No. ABOO1872, Feb. 13, 1998.*
Urano, GenBank Accession No. AB002058, Aug. 29, 1997.*
Inoue et al. GenBank Accession No. AB002135, Jul. 23, 1999.*
Watanabe, GenBank Accession No. AB003723, Feb. 25, 1998.*
Kamei, GenBank Accession No. AB003592, Jul. 19, 1999.*
Ohno, GenBank Accession No. AB000114, Feb. 5, 1999.*
Shimomura, GenBank Accession No. AB000095, Mar. 4, 1998.*
Satoh, GenBank Accession No. AB000276, Nov. 6, 1997.*
Fukunaga, GenBank Accession No. AB000409, Feb. 5, 1999.*
Yokouchi, GenBank Accession No. AB000520, Sep. 26, 1997.*
Fukuta, GenBank Accession No. AB003791, Feb. 14, 1998.*
Okumoto, GenBank Accession No. AB004546, Jul. 11, 1998.*
Ikeda, GenBank Accession No. AB000812, Feb. 20, 1999.*
Ishihara, GenBank Accession No. AB003333, Feb. 26, 1999.*
Rockman et al. Australian Journal of Medical Science. May 1994. 15: 56–57.*

* cited by examiner

*Primary Examiner*—Carla J. Myers
(74) *Attorney, Agent, or Firm*—Hovey Williams LLP

(57) ABSTRACT

Nucleic acid (e.g., DNA) hybridization probes are described which comprise a labeled, single copy nucleic acid which hybridizes to a deduced single copy sequence interval in target nucleic acid of known sequence. The probes, which are essentially free of repetitive sequences, can be used in hybridization analyses without adding repetitive sequence-blocking nucleic acids. This allows rapid and accurate detection of chromosomal abnormalities. The probes are preferably designed by first determining the sequence of at least one single copy interval in a target nucleic acid sequence, and developing corresponding hybridization probes which hybridize to at least a part of the deduced single copy sequence. In practice, the sequences of the target and of known genomic repetitive sequence representatives are compared in order to deduce locations of the single copy sequence intervals. The single copy probes can be developed by any variety of methods, such as PCR amplification, restriction or exonuclease digestion of purified genomic fragments, or direct synthesis of DNA sequences. This is followed by labeling of the probes and hybridization to a target sequence.

8 Claims, 6 Drawing Sheets

(6 of 6 Drawing Sheet(s) Filed in Color)

SINGLE COPY GENOMIC HYBRIDIZATION PROBES AND METHOD OF GENERATING SAME

SEQUENCE LISTING

A printed Sequence Listing accompanies this application, and has also been submitted with identical contents in the form of a computer-readable ASCII file on a floppy diskette.

BACKGROUND OF THE INVENTION

1. Field of the Invention

The present invention is broadly concerned with a method for designing single copy hybridization probes useful in the fields of cytogenetics and molecular genetics for determining the presence of specific nucleic acid sequences in a sample of eukaryotic origin, e.g., the probes may be used to analyze specific chromosomal locations by in situ hybridization as a detection of acquired or inherited genetic diseases. More particularly, the invention pertains to such probes, hybridization methods of use thereof and techniques for developing the probes, where the probes are essentially free of genomic repeat sequences, thereby eliminating the need for disabling of repetitive sequences which is required with conventional probes.

2. Description of the Prior Art

Chromosome abnormalities are associated with various genetic disorders, which may be inherited or acquired. These abnormalities are of three general types, extra or missing individual chromosomes (aneuploidy), extra or missing portions of chromosomes (including deletions, duplications, supernumerary and marker chromosomes), or chromosomal rearrangements. The latter category includes translocations (transfer of a piece from one chromosome onto another chromosome), inversions (reversal in polarity of a chromosomal segment), insertions (transfer of a piece from one chromosome into another chromosome) and isochromosomes (chromosome arms derived from identical chromosomal segments). The abnormalities may be present only in a subset of cells (mosaicism), or in all cells. Inherited or constitutional abnormalities of various types occur with a frequency of about one in every 250 human births, with results which may be essentially benign, serious or even lethal. Chromosomal abnormalities are common and often diagnostic in acquired disorders such as leukemia and other cancers.

Hybridization probes have been developed in the past for chromosome analysis and diagnosis of abnormalities. The probes comprise clone or amplified genomic sequences or cDNA. For example, U.S. Pat. Nos. 5,447,841, 5,663,319 and 5,756,696 describe hybridization probes in the form of labeled nucleic acids which are complementary to nucleic acid segments within target chromosomal DNA. However, these probes contain repetitive sequences and therefore must be used in conjunction with blocking nucleic acids which are substantially complementary to repetitive sequences in the labeled probes. That is, these prior art probes are either pre-reacted with the blocking nucleic acids so as to bind and block the repetitive sequences therein, or such blocking nucleic acids are present in the hybridization reaction mixture. If the repetitive sequences in the probes are not disabled in some manner, the probes will react with the multiple locations in the target chromosomal DNA where the repetitive sequences reside and will not specifically react with the single copy target sequences. This problem is particularly acute with interspersed repeat sequences which are widely scattered throughout the genome, but also is present with tandem repeats clustered or contiguous on the DNA molecule. The requirement for repeat sequence disabilization by using complementary blocking nucleic acids reduces the sensitivity of the existing probes. Reliable, easily detectable signals require DNA probes of from about 40–100 kb.

The prior art also teaches that cloned probes presumed to contain single copy sequences can be identified based on their lack of hybridization to genomic DNA. In these other studies, hybridization is first performed with probes that contain pools of clones in which each recombinant DNA clone has been individually selected so that it hybridizes to single-copy sequences or very low copy repetitive sequences. A prerequisite step in this prior art is to identify single copy sequences by experimental hybridization of labeled genomic DNA to a candidate DNA probe by Southern or dot-blot hybridization. Positive hybridization with labeled total genomic DNA usually indicates that the candidate DNA probe contains a repetitive sequence and eliminates it from consideration as a single copy probe. Furthermore, an experimental hybridization of a DNA probe with total genomic DNA may fail to reveal the presence of multicopy repetitive sequences that are not abundant (<100 copies) or are infrequent in the genome. Such sequences represent a small fraction of the labeled genomic DNA and the signal they contribute will be below the limits of detection.

It has also been suggested to physically remove repeat sequences from probes by experimental procedures (Craig et al., Hum. Genet., 100:472476 (1997); Durm et al., Biotech., 24:820–825 (1998)). This procedure involves prehybridizing a polymerase chain reaction (PCR)-amplified genomic probe with an excess of purified repetitive sequence DNA prior to applying the probe to the DNA target. The resulting purified probe is depleted of repetitive sequences. This procedure is in principle very similar to other procedures that disable the hybridization of repetitive sequences in probes, but the technique is time-consuming and does not provide any advantages over the probes described in U.S. Pat. Nos. 5,447,841 and 5,756,696.

SUMMARY OF THE INVENTION

The present invention overcomes the problem outlined above and provides nucleic acid (e.g., DNA) hybridization probes comprising a labeled, single copy nucleic acid which hybridizes with a deduced single copy sequence interval in target nucleic acid of known sequence. Generally speaking, the probes of the invention are designed by comparing the sequence of a target nucleic acid with known repeat sequences in the genome of which the target is a part; with this information it is possible to deduce the single copy sequences within the target (i.e., those sequences which are essentially free of repeat sequences which, due to the lack of specificity, can mask the hybridization signal of the single copy sequences). As can be appreciated, these initial steps require knowledge of the sequences both of the target and genomic repeats, information which is increasingly available owing to the Human Genome Project and related bioinformatic studies. Furthermore, readily available computer software is used to derive the necessary single copy sequences.

The probes hereof are most preferably complementary to the target sequence, i.e., there is a 100% complementary match between the probe nucleotides and the target sequence. More broadly, less than 100% correspondence probes can be used, so long as the probes adequately hybridize to the target sequence, e.g., there should be at least about 80% sequence identity between the probe and a sequence which is a complement to target sequences, more preferably at least about 90% sequence identity.

Nucleic acid fragments corresponding to the deduced single copy sequences can be generated by a variety of methods, such as PCR amplification, restriction or exonuclease digestion of purified genomic fragments, or direct nucleic acid synthesis. The single copy fragments are then purified to remove any potentially contaminating repeat sequences, such as, for example, by electrophoresis or denaturing high pressure liquid chromatography; this is highly desirable because it eliminates spurious hybridization and detection of unrelated genomic sequences.

The probe fragments may then be cloned into a recombinant DNA vector or directly labeled. The probe is preferably labeled by nick translation using a modified or directly labeled nucleotide. The labeled probe is then denatured and hybridized, preferably to fixed chromosomal preparations on microscope slides or alternately to purified nucleic acid immobilized on a filter, slide, DNA chip, or other substrate. The probes can then be hybridized to chromosomes according to conventional fluorescence in situ hybridization (FISH) methods such as those described in U.S. Pat. Nos. 5,985,549 or 5,447,841; alternately, they can be hybridized to immobilized nucleic acids according to the techniques described in U.S. Pat. Nos. 5,110,920 or 5,273,881. Probe signals may be visualized by any of a variety of methods, such as those employing fluorescent, immunological or enzymatic detection reagents.

BRIEF DESCRIPTION OF THE DRAWINGS

The application file contains at least one drawing executed in color. Copies of this patent and patent application publication with color drawing(s) will be provided by the Office upon request and payment of the necessary fee.

FIG. 1 illustrates hybridization results using the 5170 bp HIRA probe described in Example 1, and wherein the probe was reacted with purified repetitive DNA sequences;

FIG. 2 illustrates a comparative hybridization identical to that depicted in FIG. 1, using the same 5170 bp HIRA probe but without pre-reaction with purified repetitive DNA sequences;

FIG. 3 illustrates hybridization results using the 3544 bp 15q11-q13 probe pre-reacted with purified repetitive DNA;

FIG. 4 illustrates results in a comparative experiment using the 3544 bp 15q11-q13 probe without pre-reaction with purified repetitive DNA;

FIG. 5 illustrates hybridization results using the 4166 bp, 3544 bp and 2290 bp 15q11-q13 probes described in Example 2, without pre-reaction with purified repetitive DNA sequences;

FIG. 6 illustrates hybridization results using the 5170 bp, 3691 bp, 3344 bp and 2848 bp HIRA probes described in Example 1 without pre-reaction with purified repetitive DNA sequences;

FIG. 7 illustrates hybridization results using the 4823 bp 1p36.3 probe described in Example 2 on metaphase cells of a normal individual, with pre-reaction with purified repetitive DNA sequences;

FIG. 8 illustrates a comparative hybridization result using the 4823 bp 1p36.3 probe of FIG. 7 without pre-reaction with purified repetitive DNA sequences;

FIG. 9 illustrates hybridization results using the 4724 bp and 4823 bp 1p36.3 probes described in Example 2 with pre-reaction with purified repetitive DNA sequences, and wherein single copy hybridizations were observed on homologous pairs of chromosome 1s;

FIG. 10 illustrates a comparative hybridization result using the 4724 bp and 4823 bp 1p36.3 probes described in Example 2 without pre-reaction with purified repetitive DNA sequences, and depicting the same single copy hybridizations shown in FIG. 9;

FIG. 11 illustrates hybridization results using the 4166 bp, 3544 bp and 2290 bp 15q11-q13 probes described in Example 2 without pre-reaction with purified DNA sequences on metaphase cells of a patient affected with Prader-Willi syndrome and known to harbor a deletion of 15q11-q13 sequences for one chromosomal allele, with a star indicating lack of hybridization at the deleted chromosome position and with the arrow indicating hybridization to a single chromosome; and FIG. 12 illustrates hybridization results using the 3691 bp, 3344 bp and 2848 bp HIRA probes described in Example 1 without pre-reaction with purified DNA sequences on metaphase cells of a patient affected with DiGeorge/Velo-Cardio-Facial Syndrome (VCFS) known to harbor a deletion of 22q11.2 sequences, wherein the star indicating lack of hybridization at the deleted chromosome position and the arrow indicating a normal homolog.

DETAILED DESCRIPTION OF THE PREFERRED EMBODIMENT

Figure 1:
FIGS. 1–12 are respective CCD camera images of FISH experiments wherein various gene-specific digoxigenin-dUTP labeled probes were hybridized on metaphase cells and detected with rhodamine conjugated antibody to digoxigenin and where the chromosomes were counterstained with 4,6-diamidino-2-phenylindole (DAPI). Chromosomes with one or both chromatids hybridized are indicated by arrows whereas a star indicates the absence of normally expected hybridizations. In particular.

The present invention is concerned with nucleic acid (e.g., DNA) hybridization probes useful for detection of genetic or neoplastic disorders. The probes are in the form of labeled nucleic acid fragments or a collection of labeled nucleic acid fragments whose hybridization to a target sequence can be detected. The invention also pertains to methods of developing, generating and labeling such probes, and to uses thereof.

The labeled probes hereof may be used with any nucleic acid target that may potentially contain repetitive sequences. These target sequences may include, but are not limited to chromosomal or purified nuclear DNA, heteronuclear RNA, or mRNA species that contain repetitive sequences as integral components of the transcript. In the ensuing detailed explanation, the usual case of a DNA target sequence and DNA probes is discussed; however, those skilled in the art will understand that the discussion is equally applicable (with art-recognized differences owing to the nature of the target sequences and probes) to other nucleic acid species.

An important characteristic of the probes of the invention is that they are made up of "single copy" or "unique" DNA sequences which are both complementary to at least a portion of the target DNA region of interest and are essentially free of sequences complementary to repeat sequences within the genome of which the target region is a part. Accordingly, a probe made up of a single copy or unique sequence is complementary to essentially only one sequence in the corresponding genome. As used herein, a "repeat sequence" is a sequence which repeatedly appears in the genome of which the target DNA is a part, with a sequence identity between repeats of at least about 60%, more preferably at least about 80%, and which is of sufficient length or has other qualities which would cause it to interfere with the desired specific hybridization of the probe to the target DNA, i.e., the probe would hybridize with multiple copies of the repeat sequence. Generally speaking, a repeat sequence appears at least about 10 times in the genome (more preferably at least about 50 times, and most preferably at least about 200 times) and has a length of at least about 50 nucleotides, and more preferably at least about 100 nucleotides. Repeat sequences can be of any variety, e.g., tandem, interspersed, palindromic or shared repetitive sequences (with some copies in the target region and some elsewhere in the genome), and can appear near the centromeres of chromosomes, distributed over a single chromosome, or throughout some or all chromosomes. Normally, with but few exceptions, repeat sequences do not express physiologically useful proteins.

Repetitive sequences occur in multiple copies in the haploid genome. The number of copies can range from two to hundreds of thousands, wherein the Alu family of repetitive DNA are exemplary of the latter numerous variety. The copies of a repeat may be clustered or interspersed throughout the genome. Repeats may be clustered in one or more locations in the genome, for example, repetitive sequences occurring near the centromeres of each chromosome, and variable number tandem repeats (VNTRs) Nakamura et al, Science, 235: 1616 (1987); or the repeats may be distributed over a single chromosome for example, repeats found only on the X chromosome as described by Bardoni et al., *Cytogenet. Cell Genet.*, 46: 575 (1987); or the repeats may be distributed over all the chromosomes, for example, the Alu family of repetitive sequences.

Simple repeats of low complexity can be found within genes but are more commonly found in non-coding genomic sequences. Such repeated elements consist of mono-, di-, tri-, tetra-, or penta-nucleotide core sequence elements arrayed in tandem units. Often the number of tandem units comprising these repeated sequences varies at the identical locations among genomes from different individuals. These repetitive elements can be found by searching for consecutive runs of the core sequence elements in genomic sequences.

As used herein, "sequence identity" refers to a relationship between two or more polynucleotide sequences, namely a reference sequence and a given sequence to be compared with the reference sequence. Sequence identity is determined by comparing the given sequence to the reference sequence after the sequences have been optimally aligned to produce the highest degree of sequence similarity, as determined by the match between strings of such sequences. Upon such alignment, sequence identity is ascertained on a position-by-position basis, e.g., the sequences are "identical" at a particular position if at that position, the nucleotides are identical. The total number of such position identities is then divided by the total number of nucleotides or residues in the reference sequence to give % sequence identity. Sequence identity can be readily calculated by known methods, including but not limited to, those described in Computational Molecular Biology, Lesk, A. N., ed., Oxford University Press, New York (1988), Biocomputing: Informatics and Genome Projects, Smith, D. W., ed., Academic Press, New York (1993); Computer Analysis of Sequence Data, Part I, Griffin, A. M., and Griffin, H. G., eds., Humana Press, New Jersey (1994); Sequence Analysis in Molecular Biology, von Heinge, G., Academic Press (1987); Sequence Analysis Primer, Gribskov, M. and Devereux, J., eds., M. Stockton Press, New York (1991); and Carillo, H., and Lipman, D., SIAM J. Applied Math., 48: 1073 (1988). Preferred methods to determine the sequence identity are designed to give the largest match between the sequences tested. Methods to determine sequence identity are codified in publicly available computer programs which determine sequence identity between given sequences. Examples of such programs include, but are not limited to, the GCG program package (Devereux, J., et al., *Nucleic Acids Research*, 12(1):387 (1984)), BLASTP, BLASTN and FASTA (Altschul, S. F. et al., *J. Molec. Biol.*, 215:403410 (1990). The BLASTX program is publicly available from NCBI and other sources (BLAST Manual, Altschul, S. et al., NCBI, NLM, NIH, Bethesda, Md. 20894, Altschul, S. F. et al., *J. Molec. Biol.*, 215:403410 (1990)). These programs optimally align sequences using default gap weights in order to produce the highest level of sequence identity between the given and reference sequences. As an illustration, by a polynucleotide having a nucleotide sequence having at least, for example, 95% "sequence identity" to a reference nucleotide sequence, it is intended that the nucleotide sequence of the given polynucleotide is identical to the reference sequence except that the given polynucleotide sequence may include up to 5 differences per each 100 nucleotides of the reference nucleotide sequence. In other words, in a polynucleotide having a nucleotide sequence having at least 95% identity relative to the reference nucleotide sequence, up to 5% of the nucleotides in the reference sequence may be deleted or substituted with another nucleotide, or a number of nucleotides up to 5% of the total nucleotides in the reference sequence may be inserted into the reference sequence. Inversions in either sequence are detected by these computer programs based on the similarity of the reference sequence to the antisense strand of the homologous test sequence. These variants of the reference sequence may occur at the 5' or 3' terminal positions of the reference nucleotide sequence or anywhere between those terminal positions, interspersed either individually among nucleotides in the reference sequence or in one or more contiguous groups within the reference sequence.

The single copy probes of the invention preferably should have a length of at least about 50 nucleotides, and more preferably at least about 100 nucleotides. Probes of this length are sufficient for Southern blot analyses. However, if other analyses such as FISH are employed, the probes should be somewhat longer, i.e., at least bout 500 nucleotides, and more preferably at least about 2000 nucleotides in length. The probes can be used to detect virtually any type of chromosomal rearrangement, such as deletions, duplications, insertions, additions, inversions or translocations.

In order to develop probes in accordance with the invention, the sequence of the target DNA region must be known. The target region may be an entire chromosome or only portions thereof where rearrangements have been identified. With this sequence knowledge, the objective is to determine the boundaries of single copy or unique sequences within the target region. This is preferably accomplished by inference from the locations of repetitive sequences within the target region. Normally, the sequence of the target region is compared with known repeat sequences from the corresponding genome, using available computer software. Once the repeat sequences within the target region are identified, the intervening sequences are deduced to be single copy (i.e., the sequences between adjacent repeat sequences).

Optimal alignment of the target and repetitive sequences for comparison may be conducted by the local homology algorithm of Smith et al., *Adv. Appl. Math.*, 2:482 (1981), by the homology alignment algorithm of Needleman et al., *J. Mol. Biol.*, 48:443 (1970). The results obtained from the heuristic methods (Pearson, et al. *Proc. Natl. Acad. Sci. (USA)*, 85:244 (1988); Altschul et al., 1990) are generally not as comprehensive as the methods of Smith et al. 1981 and Needlemean et al., 1970. However, they are faster than these methods.

Once the single copy sequence information is obtained, certain of the single copy sequences (normally the longest) are used to design hybridization probes. In this regard, probes may be of varying "complexity" as defined by Britten et al., *Methods of Enzymol.*, 29:363 (1974) and as further explained by Cantor et al., *Biophysical Chemistry: Part III: The Behavior of Biological Macromolecules*, at 1228–1230. The complexity of selected probes is dependent upon the application for which it is designed. In general, the larger the target area, the more complex the probe. The complexity of a probe needed to detect a set of sequences will decrease as hybridization sensitivity increases. At high sensitivity and low background, smaller and less complex probes can be used.

With current hybridization techniques, it is possible to obtain reliable, easily detectable signals with relatively small probes in accordance with the invention. A readily detectable signal was obtained with a probe on the order of 2.3 kb in length, using FISH technology. This sensitivity of the present method is improved compared to the prior art (U.S. Pat. No. 5, 756,696) because the probes of the present invention are homogeneous single copy sequences. However, smaller amplified segments, each comprising non-repetitive sequences, may also be used in combination as probes to achieve adequate signals for in situ hybridization.

One application of the use of multiple fragment probes is in the detection of translocations involving two different chromosomes. Proportionately increasing the complexity of the probe also permits analysis of multiple compact regions of the genome simultaneously. The portion of the probe targeted to one side of the break point can be labeled differently from that targeted to the other side of the break point so that the fused translocated chromosome is detected by both labels and is distinguishable from the intact chromosome.

Once appropriate single copy sequences have been identified, PCR is preferably used for amplifying the appropriate DNA to obtain probes. The PCR is a well known technique for amplifying specific DNA segments in geometric progression and relies upon repeated cycles of DNA polymerase-catalyzed extension from a pair of oligonucleotide primers with homology to the 5' end and to the complement of the 3' end of the DNA segment to be amplified.

The nucleic acid (DNA) that serves as the PCR template may be single stranded or double stranded, but when the DNA is single stranded, it will typically be converted to double stranded. The length of the template DNA may be as short as 50 bp, but usually will be at least about 100 bp long, and more usually at least about 150 bp long, and may be as long as 10,000 bp or longer, but will usually not exceed 50,000 bp in length, and more usually will not exceed 20,000 bp in length. The DNA may be free in solution, flanked at one or both ends with non-template DNA, present in a cloning vector such as a plasmid and the like, with the only criteria being that the DNA be available for participation in the primer extension reaction. The template DNA may be derived from a variety of different sources, so long as it is complementary to the target chromosomal or immobilized DNA sequence. The amount of template DNA that is combined with the other reagents will range from about 1 molecule to 1 pmol, usually from about 50 molecules to 0.1 pmol, and more usually from about 0.01 pmol to 100 fmol. The oligonucleotide primers with which the template nucleic acid is contacted will be of sufficient length to provide for hybridization to complementary template DNA under annealing conditions but will be of insufficient length to form stable hybrids with template DNA under polymerization conditions. The primers will generally be at least about 10 nt in length, usually at least 15 nt in length and more usually at least 16 nt in length and may be as long as 30 nt in length or longer, where the length of the primers will generally range from 18 to 50 nt in length, usually from about 20 to 35 nt in length. The yield of longer amplification products can be enhanced using primers of 30 to 35 nt and high fidelity polymerases (described in U.S. Pat. No. 5,436, 149).

To maximize the signal intensity obtained during in situ hybridization, primer sequence pairs are preferred which, upon amplification, produce a DNA fragment that spans nearly the entire length of each single-copy genomic sequence interval. Hence, contiguous or closely spaced primer pairs are generally excluded from consideration as probes for in situ hybridization. With the exception of cytogenetic preparations, this criterion is generally not applicable for probes that are hybridized to immobilized cloned or synthetic nucleic acid targets, since signal intensities of shorter probes are usually adequate due to the increased number of target molecules.

However, in order to optimize the yield and kinetics of the PCR reaction, the desired primer sequences are also subject to other criteria. First, a primer sequence should not be substantially self-complementary or complementary to the second primer. In particular, potential primer sequences are excluded which could result in the formation of stable hybrids involving the 3' terminus of the primer and either another sequence in the same or the second primer (defined as $\geq 6$ base pairs). Additionally, the $T_m$ of one member of the primer pair should occur within 2° C. of its counterpart, which enables them to denature and anneal to the template nearly simultaneously. Software is well known in the art to identify primer sequences that satisfy all of the preferred criteria.

The PCR reaction mixture will normally further comprise an aqueous buffer medium which includes a source of monovalent ions, a source of divalent cations and a buffering agent. Any convenient source of monovalent ions, such as KCl, K-acetate, $NH_4$-acetate, K-glutamate, $NH_4Cl$, ammonium sulfate, and the like may be employed, where the amount of monovalent ion source present in the buffer will typically be present in an amount sufficient to provide for a conductivity in a range from about 500 to 20,000, usually from about 1000 to 10,000, and more usually from about 3,000 to 6,000 microohms. The divalent cation may be magnesium, manganese, zinc and the like, where the cation will typically be magnesium. Any convenient source of magnesium cation may be employed, including $MgCl_2$, Mg-acetate, and the like. The amount of $Mg^{+2}$-present in the buffer may range from 0.5 to 10 mM, but will preferably range from about 2 to 4 mM, more preferably from about 2.25 to 2.75 mM and will ideally be at about 2.45 mM. Representative buffering agents or salts that may be present in the buffer include Tris, Tricine, HEPES, MOPS and the like, where the amount of buffering agent will typically range from about 5 to 150 mM, usually from about 10 to 100 mM, and more usually from about 20 to 50 mM, where in certain preferred embodiments the buffering agent will be present in an amount sufficient to provide a pH ranging from about 6.0 to 9.5, where most preferred is pH 7.3 at 72° C. Other agents which may be present in the buffer medium include chelating agents, such as EDTA, EGTA and the like.

Also present in the PCR reaction mixtures is a melting point reducing agent, i.e. a reagent that lowers the melting point of DNA. Suitable melting point reducing agents are those agents that interfere with the hydrogen bonding interaction of two nucleotides, where representative base pair destabilization agents include: betaine, formamide, urea, thiourea, acetamide, methylurea, glycinamide, and the like, where betaine is a preferred agent The melting point reducing agent will typically be present in amounts ranging from about 20 to 500 mM, usually from about 50 to 200 mM and more usually from about 80 to 150 mM.

In preparing the PCR reaction mixture, the various constituent components may be combined in any convenient order. For example, the buffer may be combined with primer, polymerase and then template DNA, or all of the various constituent components may be combined at the same time to produce the reaction mixture.

Following preparation of the PCR reaction mixture, it is subjected to a plurality of reaction cycles, where each reaction cycle comprises: (1) a denaturation step, (2) an annealing step, and (3) a polymerization step. The number of reaction cycles will vary depending on the application being performed, but will usually be at least 15, more usually at least 20 and may be as high as 60 or higher, where the number of different cycles will typically range from about 20 to 40. For methods where more than about 25, usually more than about 30 cycles are performed, it may be convenient or desirable to introduce additional polymerase into the reaction mixture such that conditions suitable for enzymatic primer extension are maintained.

The denaturation step comprises heating the reaction mixture to an elevated temperature and maintaining the mixture at the elevated temperature for a period of time sufficient for any double stranded or hybridized nucleic acid present in the reaction mixture to dissociate. For denaturation, the temperature of the reaction mixture will usually be raised to, and maintained at, a temperature ranging from about 85 to 100° C. usually from about 90 to 98° C., and more usually from about 93 to 96° C. for a period of time ranging from about 3 to 120 seconds, usually from about 5 to 30 seconds.

Following denaturation, the PCR reaction mixture will be subjected to conditions sufficient for primer annealing to template DNA present in the mixture. The temperature to which the reaction mixture is lowered to achieve these conditions will usually be chosen to provide optimal efficiency and specificity, and will generally range from about 50 to 75° C., usually from about 55 to 70° C. and more usually from about 60 to 68° C. Annealing conditions will be maintained for a period of time ranging from about 15 seconds to 30 minutes, usually from about 30 seconds to 5 minutes.

Following annealing of primer to template DNA or during annealing of primer to template DNA, the reaction mixture will be subjected to conditions sufficient to provide for polymerization of nucleotides to the primer ends in manner such that the primer is extended in a 5' to 3' direction using the DNA to which it is hybridized as a template, i.e. conditions sufficient for enzymatic production of primer extension product. To achieve polymerization conditions, the temperature of the reaction mixture will typically be raised to or maintained at a temperature ranging from about 65 to 75° C., usually from about 67 to 73° C. and maintained for a period of time ranging from about 15 seconds to 20 minutes, usually from about 30 seconds to 5 minutes.

The above cycles of denaturation, annealing and polymerization may be performed using an automated device, typically known as a thermal cycler. Thermal cyclers that may be employed are described in U.S. Pat. Nos. 5,612,473; 5,602,756; 5,538,871; and 5,475,610.

In addition to the PCR, DNA fragments corresponding to unique sequences can also be obtained by a variety of other methods, including but not limited to deletion mutagenesis, restriction digestion, direct synthesis and DNA ligation.

If the genomic fragment is obtained by amplification or purification from DNA containing repetitive sequences, the fragment must then be purified prior to labeling and hybridization. Purification of homogeneously-sized DNA fragments can be accomplished by a variety of methods, including but not limited to electrophoresis and high pressure liquid chromatography. In the preferred method, amplified fragments are separated according to size by gel electrophoreses in Seakem L E Agarose using Tris Acetate buffer (Sambrook, Fritsch & Maniatis, Molecular Cloning: A Laboratory Manual [Cold Spring Harbor Laboratory Press, 1989]), stained with a dye such as ethidium bromide or Syber-Green, visualized with ultraviolet light (300 nm), excised from the gel using a scalpel. Each DNA fragment is then recovered from the gel fragment using a Micro-con 100 (Millipore, Watertown, Mass.) column by spin centrifugation.

Phenol-chloroform extraction of the amplified DNA is not an adequate method of purification. When this approach was tested, this purification technique resulted in nonspecific hybridization to all chromosomes along their entire length, which is consistent with the pattern produced by hybridization of repetitive sequences (data not shown). This occurs because, during the PCR process, DNA polymerase extends the replicated strand past the position of the second primer into adjacent repetitive sequences if the initial template contains genomic DNA sequences. These extension products which are longer than the amplification product, are present in all such PCR reactions. Since, in the present method, repetitive sequences are adjacent to the segments being amplified, the extension products are likely to contain such sequences. Phenol-chloroform extraction of PCR reactions does not remove such extension products. PCR reaction mixtures containing these sequences may hybridize to repetitive genomic DNA in addition to the target sequence. Hence, isolation of the purified genomic amplification fragment (whether it is obtained directly from genomic DNA or by PCR), is a preferred embodiment of the subject invention and would not be obvious to one skilled in the art.

Insertion of the purified fragments into plasmids, bacteriophages, or artificial chromosome cloning vehicles capable of being propagated in E. coli, yeast, or other species may be desirable to reduce the cost and labor required for repeated preparation of single copy DNA probes. A variety of cloning vectors have been optimized for rapid ligation and selection for vectors containing PCR products (for example: U.S. Pat. Nos. 5,487,993 and 5,766,891). If the probe will be used in multiple hybridizations, then the cloned recombinant form will be less expensive to produce in large quantities than by iterative PCR amplification from the same genomic DNA template. In addition, genomic insert in the cloned probe does not have to be isolated during purification, since the fragment recombined with vector is propagated in the absence of any other genomic DNA that could potentially contain repetitive sequences. Finally, the cloned vehicle provides a potentially inexhaustible source of probe, whereas natural genomic DNA templates may have to be reisolated from cell lines or from other sources. Single copy DNA fragments obtained by PCR amplification as described above are isolated according to size by gel electrophoresis and purified by columns as is well known in the art.

These fragments are then labeled with nonisotopic identifying label such as a fluorophore, an enzymatic conjugate, or one selected from the group consisting of biotin or other moieties recognized by avidin, streptavidin, or specific antibodies. There are several types of non-isotopic identifying labels. One type is a label which is chemically bound to the probe and serves as the means for identification and localization directly. An example of this type would be a fluorochrome moiety which upon application of radiation of proper wavelengths will become excited into a high energy state and emit fluorescent light. The probes can be synthesized chemically or preferably be prepared using the methods of nick-translation (Rigby et al., *J. Mol. Biol.*, 113:237–251, 1977) or Klenow labeling (Feinberg et al., *Anal. Biochem.* 137:266–267, 1984) in the conventional manner using a reactant comprising the identifying label of choice (but not limited to) conjugated to a nucleotide such as dATP or dUTP. The fragments are either directly labeled with a fluorophore-tagged nucleotide or indirectly labeled by binding the labeled duplex to a fluorescently-labeled antibody that recognizes the modified nucleotide that is incorporated into the fragment as described below. Nick-translations (100 μl reaction) utilize endonuclease-free DNA polymerase I (Roche Molecular Biochemicals) and DNaseI (Worthington Chemical). Each fragment is combined with DNA polymerase (20 units/microgram DNA), DNaseI (10 microgram/100 μl reaction), labeled nucleotide (0.05 mm final) and nick translation buffer. The reaction is performed at 15° C. for 45 minutes to 2 hours and yields a variety of labeled probe fragments of different nucleotide sizes in the 100 to 500 bp size range.

Other methods for labeling and detecting probes in common use may be applied to the single-copy DNA probes produced by the present method. These include: fluorochrome labels (which resolve labeling on individual chromatids which serves as an affirmation that hybridization occurred unequivocally, and further allows detection precisely at site of hybridization rather than at some distance away), chemical reagents which yields an identifiable change when combined with the proper reactants (for example, alkaline phosphatase, horseradish peroxidase and galactosidase, each of which reacts and provide a detectable color change that identifies the presence and position of the target sequence), indirect linkage mechanism of specifically binding entities (such as the biotin-avidin system in which the probe is preferably joined to biotin by conventional methods and added to an avidin- or streptavidin-conjugated fluorochrome or enzyme which provides the specificity for attaching the fluorochrome or enzyme to the probe).

It will be recognized also that other identifying labels may also be used with the described probes. These include fluorescent compositions such as energy transfer groups, conjugated proteins, antibodies and antigens, or radioactive isotopes.

Chromosomal hybridization and detection are a preferred use of DNA probes generated by the present invention. DNA probes generated by the present method may be hybridized either directly to complementary nucleic acids in cells (in situ hybridization) or to nucleic acids immobilized on a substrate. A preferred use of the method is in situ hybridization, which is well known in the art, being described in U.S. Pat. Nos. 5,985,549; 5,447,841; 5,756,696; 5,869,237. Based on early work of Gall and Pardue (PNAS 63:378–383, 1969), isotopic in situ hybridization was established in the 1970s (see Gerhard et al., PNAS 78:3755–3759,1981 and Harper et al., PNAS 78:4458–4460, 1981 as examples) and subsequently nonisotopic in situ hybridization was established. The technique of nonisotopic in situ hybridization is reviewed and a protocol is provided for use in chromosomal hybridization by Knoll and Lichter, in Current Protocols in Human Genetics, Vol. 1, Unit 4.3 (Green Wiley, New York, 1994) and in U.S. Pat. No. 5,985,549. The technique relies on the formation of duplex nucleic acid species, in which one strand is derived from a labeled probe molecule and the second strand comprises the target to be detected. Target molecules may comprise chromosomes or cellular nucleic acids. Numerous methods have been developed to label the probe and visualize the duplex.

The present method is intended to be used with any nucleic acid target containing repetitive sequences. The sample containing the target nucleic acid sequence can be prepared from cellular nuclei, morphologically intact cells (or tissues), chromosomes, other cellular material components, or synthetically produced nucleic acid. The sample may be obtained from the fluids or tissues of a mammal, preferably human, which are suspected of being afflicted with a disease or disorder either from a biopsy or post-mortem, or plants.

As an example, chromosomal preparations can be made in the following manner: phytohemagglutinin-stimulated peripheral lymphocytes are cultured in RPMI 1640 medium containing 10% fetal calfserum for 72 hours at 37° C. Ethidium bromide (100 ug/10 ml final) is added 1½ hours prior to harvest. Colcemid (1 ug/10 ml final) is added during the final 20 min of incubation with ethidium bromide. The cells are then pelleted by centrifugation and incubated preferably in 0.075 M KCl at 37° C. for about 20 minutes. Cells are then pelleted again and fixed in 3 changes of Carnoy's fixative (3:1 methanol:acetic acid volumetric ratio) using conventional cytogenetic techniques. [For a review of chromosome preparation from peripheral blood cells, see Bangs and Donlon in Dracopoli et al., Current Protocols in Human Genetics, Vol. 1, Unit 4.1 (Green-Wiley, New York, 1994)]. The nuclei or cells in suspension can then be dropped onto clear glass coverslips or slides in a humid environment to promote chromosome spreading. The coverslips or microscope slides can then be preferentially air dried overnight, aged or stored until required for use in in situ hybridization.

Immediately prior to chromosomal denaturation in the in situ hybridization procedure, the dried or stored chromosome preparations can be pretreated in prewarmed 2×SSC (components are in Sambrook, Fritsch & Maniatis, Molecular Cloning: A Laboratory Manual [Cold Spring Harbor Laboratory Press, 1989]) for 30 minutes at 37° C. followed by dehydration in an ethanol series (2 minutes each in 70%, 80%, 90% and 100% ethanol).

When the target nucleic acid sequence is DNA, DNA in the sample can be denatured by heat or alkali. [See Harper et al., PNAS USA, 78, 4458–60 (1981), for alkali denaturation and Gall et al., PNAS USA, 63:370–383 (1969)]. Denaturation is carried out so that the DNA strands are separated with minimal shearing, degradation or oxidation.

In the preferred current method, the labeled single copy probe is resuspended in deionized formamide and denatured at 70–75° C. The chromosomal template is denatured in a solution containing 70% formamide/2×SSC, pH 7.0 followed by dehydration in an ethanol series (2 minutes each in cold 70% ethanol and room temperature 80, 90 and 100% ethanol). Hybridization of the labeled probe to the corresponding template is carried out in a solution containing 50% formamide/2×SSC/10% dextran sulfate/BSA [bovine serum albumin; 1 mg/ml final] for a few hours to overnight. The length of time depending on the complexity of the probe that is utilized. After hybridization, non-hybridizing excess probe is removed by a washing procedure. The duplexes are treated with a series of 15–30 minute washes: first with a solution of 50% formamide/2×SSC at 39–45° C., then 2×SSC at 3945° C., followed by a 15–30 minute wash at room temperature in 1×SSC. The hybridized sequences are detected by relevant means. For example, digoxigenin-dUTP can be but is not limited to detection by an antibody to digoxigenin such as rhodamine or fluorescein conjugated antibody (Roche Molecular Biochemicals). Following detection, spurious detection reagents are removed by washing in varying SSC and SSC/triton-X concentrations, the chromosomes are counterstained with a dye such as DAPI and the hybridized preparation is mounted in an antifade solution such as Vectashield (Vector Laboratories). The cells are examined by fluorescence microscopy with the appropriate filter sets and imaged with a charge coupled device (CCD).

An important aspect of the present invention is that the probe or target DNA does not require pre-reaction with a non-specific nucleic acid competitor such as purified repetitive DNA or that the probe does not require experimental verification that the single copy fragments or recombinant cloned probes do not contain repetitive sequences (U.S. Pat. Nos. 5,985,549; 5,447,841; 5,663,319; 5,756,696) because the probes are single copies without repetitive elements. This results in a significantly improved signal to noise ratio. A signal to noise ratio is defined as a ratio of the probability of the probe detecting a bona fide signal of hybridization of the target nucleic acid sequence to that of the probability of detecting the background caused by non-specific binding of the labeled probe.

The hybridization reactions carried out using the probes of the invention are themselves essentially conventional. As indicated, two exemplary types of hybridizations are the Southern blot and FISH techniques, well known to those skilled in the art. However, the visual patterns resulting from use of the probes, termed indicator patterns, are extremely useful tools for cytogenetic analyses, especially molecular cytogenetic analyses. These indicator patterns facilitate microscopic and/or flow cytometric identification of normal and abnormal chromosomes and characterization of the genetic abnormalities. Since multiple compatible methods of probe visualization are available, the binding patterns of different components of the probes can be distinguished, for example, by color. Thus, the invention is capable of producing virtually any desired indicator pattern on the chromosomes visualized with one or more colors (a multi-color indicator pattern) and/or other indicator methods.

Preferred indicator patterns derived from using the probes of the invention comprise one or more "bands," meaning a reference point in a genome comprising a target DNA sequence with a probe bound thereto, and wherein the resulting duplex is detectable by some indicator. Depending on hybridization washes and the detection conditions, a band can extend from the narrow context of a sequence providing a reliable signal to a single chromosome region to multiple regions on single or plural chromosomes. The indicator bands from the probes hereof are to be distinguished from bands produced by pretreatment and chemical staining. The probe-produced bands of the present invention are based upon the complementarity of the DNA sequences, whereas bands produced by chemical staining depend upon natural characteristics of the chromosomes (such as structure or protein composition), but not by hybridization to the DNA sequences thereof. Furthermore, chemical staining techniques are useful only in connection with metaphase chromosomes, whereas the probe-produced bands of the present invention are useful for both metaphase and interphase chromosomes.

The following examples set forth the preferred techniques employed for the development, generation, labeling and use of specific DNA probes designed to hybridize to a target DNA sequence in a genome. It is to be understood, however, that these examples are provided by way of illustration and nothing therein should be taken as a limitation upon the overall scope of the invention.

EXAMPLE 1

Development of HIRA Gene Probe

A known genetic disorder on human chromosome 22 involves a deletion of one HIRA gene in chromosome band 22q11.2, i.e., in normal individuals, there are two copies of the HIRA gene, whereas in affected individuals, only one copy is present. This deletion is considered to be a cause of haploinsufficiency syndromes such as DiGeorge and Velo-Cardio-Facial Syndromes (VCFS), because insufficient amounts of gene product(s) may disrupt normal embryonic development (Fibison et al., *Amer. J. Hum. Genet.*, 46:888–95 (1990); Consevage et al., *Amer. J. Cardiol.*, 77:1023–1205 (1996)). Other syndromes including Cat Eye Syndrome and derivative chromosome 22 syndrome result from an excess of genomic sequences from this region (Mears et al., *Amer. J. Hum. Genet.*, 55:134–142 (1994); Knoll et al., *Amer. J. Med. Genet.*, 55:221–224 (1995)). Typically individuals with these syndromes have supernumerary derivative chromosome 22s.

Initially, a computer-based search using the search term "HIRA" was performed using Entrez Nucleotide software at the National Library of Medicine website. This identified a series of cDNA sequences for the HIRA gene in GenBank. The full length cDNA sequence was selected (GenBank Accession No. X81844), having 3859 bp. This cDNA sequence was then compared with the genome sequence which included draft sequences at the National Library of Medicine (http://www.ncbi.nlm.nih.gov/genome/seq/page.cgi?F=HsBlast.html&&ORG=Hs). This was done in order to determine whether genomic sequences of sufficient length were available for probe development. This comparison confirmed that the entire HIRA genomic sequence was known, and that the coding sequence interval spanned a length of 100,836 bp in the chromosome. Since the available contiguous genomic sequence in GenBank exceeded the length of the coding interval, it was possible to select an interval longer than the coding region in order to include sequences from the gene promoter at the 5' end and untranslated sequences and polyadenylation signal at the 3' end. A total genomic interval of approximately 103 kb was thus selected. Position 1 of this ~103 kb interval corresponds to position 798,334 in GenBank Accession number NT_001039.

In the next step, the selected 103 kb genomic interval was compared with known high-complexity repeat sequence family members or consensus sequences that are aligned with the test genomic sequences (SEQ ID Nos. 1–428) and all combinations of low-complexity tandem repeat sequences of at least 17 nucleotides in length (mono-, di-, tri-, tetra-, and pentanucleotide units) known to be present in the human genome (SEQ ID Nos. 447–479). This comparison was done using the publicly available CENSOR program which can be found at the Genetic Information Research Institute website, www.girinst.org. This program utilizes the Smith-Waterman global alignment comparison algorithm to determine the locations and distribution of repeat sequences within the genomic interval. A Smith-Waterman alignment of repetitive with genomic sequences was performed with the following parameters: Length of margin sequence: 50 nt, minimum length to extract insertion: 12 nt, minimum margin to combine matching fragments: 30, similarity threshold: 22, similarity threshold to always keep match: 35, ratio threshold: 2.8, relative similarity threshold: 2.8, gap constant D1: 2.95, gap constant D2: 1.90, and mismatch penalty: −1.0. This analysis generated the following table, which details the coordinates of repetitive sequence family members found in and adjacent to the human HIRA gene coding sequence.

TABLE 1

| HIRA position (bp) | | | | Position (bp) in Seq.Listing Corresponding to HIRA Match | |
|---|---|---|---|---|---|
| Begin | End | Repeat Family | SEQ ID NO. | Begin | End |
| 798411 | 798434 | (AC) | 452 | 1 | 24 |
| 798983 | 799395 | MLT2A1 | 444 | 1 | 434 |
| 801257 | 801348 | CHESHIRE_A | 420 | 132 | 223 |
| 801367 | 801729 | L1ME_ORF2 | 425 | 757 | 1089 |
| 801746 | 802032 | Alu-Jb | 2 | 2 | 289 |
| 802033 | 802308 | L1ME_ORF2 | 425 | 1090 | 1380 |
| 802355 | 802434 | L1MB6_5 | 77 | 1629 | 1710 |
| 802448 | 802798 | L1M3D_5 | 66 | 996 | 1348 |
| 802811 | 803100 | Alu-Y | 2 | 1 | 290 |
| 803104 | 803189 | L1M3D_5 | 66 | 907 | 995 |
| 803199 | 803454 | Alu-Jb | 2 | 5 | 290 |
| 803472 | 803545 | Alu-Spqxz | 2 | 2 | 76 |
| 803548 | 804061 | L1MEC_5 | 345 | 1860 | 2392 |
| 804079 | 804365 | Alu-Sz | 2 | 6 | 290 |
| 804476 | 804559 | L1P_MA2 | 348 | 6242 | 6321 |
| 804625 | 804885 | L1ME_ORF2 | 425 | 2287 | 2568 |
| 804936 | 804997 | MLT1E2 | 106 | 198 | 260 |
| 805011 | 805077 | MLT1E1 | 105 | 420 | 484 |
| 805110 | 805211 | L1PBA_5 | 359 | 103 | 204 |
| 805212 | 805862 | L1PBA_5 | 359 | 1089 | 1738 |
| 805933 | 805989 | Alu-J | 2 | 234 | 290 |
| 805991 | 806489 | L1PBA_5 | 359 | 1749 | 2247 |
| 806510 | 806624 | L1 | 59 | 1659 | 1773 |
| 806628 | 806917 | Alu-Sz | 2 | 1 | 290 |
| 806919 | 807254 | L1M2_5 | 61 | 2377 | 2716 |
| 807301 | 808176 | L1P_MA2 | 348 | 3516 | 4425 |
| 808179 | 808469 | Alu-Sz | 2 | 1 | 290 |
| 808476 | 808734 | L1 | 59 | 3268 | 3525 |
| 808735 | 809426 | L1ME_ORF2 | 425 | 1411 | 2105 |
| 809429 | 809860 | L1P_MA2 | 348 | 5607 | 6044 |
| 809861 | 809993 | Alu-Jb | 2 | 2 | 134 |
| 809996 | 810282 | Alu-Jb | 2 | 2 | 290 |
| 810345 | 811040 | L1 | 59 | 4711 | 5402 |
| 811041 | 811221 | L1PB3 | 358 | 151 | 333 |
| 811226 | 811513 | Alu-Sx | 2 | 1 | 287 |
| 811515 | 812032 | L1PB1 | 357 | 330 | 863 |
| 812096 | 812394 | Alu-Jb | 2 | 1 | 288 |
| 812474 | 812698 | Alu-Jb | 2 | 5 | 229 |
| 812721 | 812836 | Alu-Jo | 2 | 2 | 117 |
| 812862 | 812901 | L1P_MA2 | 348 | 4315 | 4354 |

TABLE 1-continued

| HIRA position (bp) | | | | Position (bp) in Seq.Listing Corresponding to HIRA Match | |
|---|---|---|---|---|---|
| Begin | End | Repeat Family | SEQ ID NO. | Begin | End |
| 812903 | 813078 | L1 | 59 | 3028 | 3222 |
| 813079 | 814102 | L1ME_ORF2 | 425 | 1113 | 2166 |
| 814323 | 814410 | MER1B | 315 | 242 | 337 |
| 814411 | 814557 | CHARLIE3 | 7 | 1 | 281 |
| 814780 | 814916 | L1MB7 | 78 | 9 | 143 |
| 815061 | 815181 | Alu-Y | 2 | 1 | 134 |
| 815420 | 815452 | LTR67 | 279 | 99 | 131 |
| 816487 | 816772 | Alu-Sx | 2 | 5 | 290 |
| 817180 | 817270 | L1MCC_5 | 335 | 1384 | 1473 |
| 817332 | 817620 | Alu-Sg | 2 | 1 | 290 |
| 817634 | 817909 | Alu-Sq | 2 | 1 | 288 |
| 817943 | 818227 | Alu-Sx | 2 | 2 | 289 |
| 818368 | 818578 | HAL1 | 18 | 1346 | 1547 |
| 818631 | 818791 | LINE2 | 362 | 2280 | 2464 |
| 818824 | 818889 | Alu-S | 2 | 223 | 290 |
| 818890 | 819185 | LINE2 | 362 | 2465 | 2749 |
| 819328 | 819450 | LINE2 | 362 | 1925 | 2049 |
| 819565 | 819757 | LINE2 | 362 | 2273 | 2498 |
| 823604 | 823892 | Alu-Jo | 2 | 2 | 290 |
| 826836 | 827042 | Alu-Sxzg | 2 | 84 | 290 |
| 827922 | 827977 | MIR | 99 | 105 | 160 |
| 830762 | 831371 | L1MEC_5 | 345 | 1498 | 2123 |
| 831396 | 831685 | Alu-Sx | 2 | 2 | 290 |
| 831687 | 831774 | L1MEC_5 | 345 | 2117 | 2205 |
| 831778 | 832066 | Alu-Sx | 2 | 1 | 290 |
| 832155 | 832288 | Alu-FLA | 2 | 5 | 134 |
| 832317 | 832431 | L1MC2 | 79 | 666 | 786 |
| 832442 | 832735 | Alu-Sz | 2 | 1 | 289 |
| 832742 | 832992 | L1MC2 | 79 | 787 | 1077 |
| 833004 | 833170 | L1ME_ORF2 | 425 | 172 | 340 |
| 833177 | 834590 | TIGGER1 | 148 | 1 | 1477 |
| 834592 | 834642 | Alu-Jb | 2 | 156 | 207 |
| 834799 | 834877 | Alu-Jb | 2 | 208 | 290 |
| 834907 | 835194 | Alu-Y | 2 | 1 | 289 |
| 835198 | 835590 | TIGGER1 | 148 | 1468 | 1900 |
| 835597 | 835888 | Alu-Sx | 2 | 1 | 290 |
| 835946 | 835979 | L1P_MA2 | 348 | 4654 | 4689 |
| 836060 | 836177 | MER2 | 316 | 229 | 345 |
| 836203 | 836486 | Alu-Sx | 2 | 7 | 290 |
| 836497 | 836712 | MER2 | 316 | 1 | 228 |
| 838477 | 838760 | Alu-Sz | 2 | 1 | 288 |
| 838822 | 839069 | Alu-Sx | 2 | 1 | 288 |
| 839086 | 839373 | Alu-Sz | 2 | 1 | 289 |
| 840297 | 840926 | L1MB7 | 78 | 269 | 915 |
| 841062 | 841306 | L1MB7 | 78 | 7 | 249 |
| 841323 | 841382 | L1ME_ORF2 | 425 | 3053 | 3116 |
| 841408 | 841697 | Alu-Sq | 2 | 1 | 290 |
| 841705 | 841828 | Alu-Jo | 2 | 1 | 136 |
| 841829 | 842012 | L1ME_ORF2 | 425 | 2870 | 3052 |
| 842744 | 842871 | MER86 | 239 | 51 | 183 |
| 842879 | 843107 | Alu-Spqxz | 2 | 3 | 230 |
| 843109 | 843271 | Alu-Jo | 2 | 9 | 175 |
| 847056 | 847210 | MER104 | 293 | 1 | 179 |
| 847256 | 847351 | L1ME4 | 343 | 128 | 224 |
| 847413 | 847551 | MIR | 99 | 65 | 218 |
| 847570 | 847695 | L1ME4 | 343 | 1 | 127 |
| 847865 | 848137 | Alu-Y | 2 | 1 | 290 |
| 848171 | 848458 | Alu-Sg | 2 | 1 | 290 |
| 848493 | 848564 | L1PA7 | 355 | 35 | 105 |
| 848646 | 848928 | Alu-Sc | 2 | 5 | 290 |
| 849186 | 849435 | L1ME_ORF2 | 425 | 2527 | 2796 |
| 849450 | 849745 | Alu-Sx | 2 | 5 | 289 |

TABLE 1-continued

| HIRA position (bp) | | | SEQ ID NO. | Position (bp) in Seq.Listing Corresponding to HIRA Match | |
|---|---|---|---|---|---|
| Begin | End | Repeat Family | | Begin | End |
| 850114 | 850249 | L1P_MA2 | 348 | 5447 | 5610 |
| 850250 | 850761 | L1 | 59 | 3478 | 4017 |
| 850824 | 850942 | L1ME_ORF2 | 425 | 1128 | 1265 |
| 851588 | 851614 | (T) | 449 (complement) | 1 | 27 |
| 851749 | 851881 | L1ME2 | 341 | 357 | 523 |
| 852607 | 852853 | L1MA10 | 72 | 664 | 918 |
| 852863 | 853156 | Alu-Sc | 2 | 1 | 290 |
| 853176 | 853211 | L1MA10 | 72 | 628 | 663 |
| 853212 | 853267 | L1MA9 | 75 | 987 | 1041 |
| 853491 | 853779 | Alu-Sz | 2 | 1 | 290 |
| 859137 | 859435 | Alu-Sx | 2 | 1 | 290 |
| 859436 | 859456 | (A) | 449 | 1 | 21 |
| 859570 | 859805 | L1ME3A | 342 | 215 | 442 |
| 859806 | 860289 | L1ME2 | 341 | 375 | 879 |
| 860318 | 860605 | Alu-Y | 2 | 1 | 290 |
| 862194 | 862481 | Alu-Sg | 2 | 1 | 290 |
| 865060 | 865350 | Alu-Sq | 2 | 1 | 290 |
| 867521 | 867800 | Alu-Jb | 2 | 1 | 288 |
| 867836 | 867876 | MIR | 99 | 157 | 196 |
| 869546 | 869802 | LINE2 | 362 | 123 | 413 |
| 869923 | 870118 | LINE2 | 362 | 1251 | 1450 |
| 870124 | 870202 | Alu-J | 2 | 48 | 132 |
| 870203 | 870296 | LINE2 | 362 | 1451 | 1592 |
| 870316 | 870666 | LINE2 | 362 | 1708 | 2097 |
| 871000 | 871075 | LINE2 | 362 | 2617 | 2736 |
| 871650 | 871935 | Alu-Jo | 2 | 1 | 290 |
| 871936 | 871960 | (GAAAAA) | 482 | 4 | 28 |
| 872154 | 872444 | Alu-Sc | 2 | 1 | 289 |
| 874867 | 874990 | L1MB7 | 78 | 529 | 676 |
| 878120 | 878408 | Alu-Sx | 2 | 1 | 290 |
| 881003 | 881054 | MLT1G | 109 | 217 | 268 |
| 881130 | 881266 | MLT1G | 109 | 269 | 480 |
| 881293 | 881346 | MLT1G | 109 | 415 | 469 |
| 881762 | 881891 | LINE2B | 363 | 85 | 229 |
| 882448 | 882740 | Alu-Sb0 | 2 | 1 | 290 |
| 883566 | 883716 | Alu-Sz | 2 | 1 | 288 |
| 883782 | 883977 | Alu-Sc | 2 | 2 | 290 |
| 883988 | 884329 | L1P_MA2 | 348 | 5600 | 5935 |
| 884333 | 884623 | Alu-Sp | 2 | 1 | 290 |
| 884624 | 885134 | L1ME_ORF2 | 425 | 2431 | 2975 |
| 885160 | 885456 | Alu-Jb | 2 | 9 | 290 |
| 888460 | 885742 | L1ME_ORF2 | 425 | 2949 | 3252 |
| 885744 | 886031 | Alu-Sx | 2 | 1 | 288 |
| 886032 | 886082 | Alu-Sp | 2 | 291 | 341 |
| 886083 | 886166 | L1MB7 | 78 | 137 | 220 |
| 886168 | 886454 | Alu-Sc | 2 | 1 | 290 |
| 886535 | 887059 | L1MB7 | 78 | 345 | 901 |
| 887169 | 887460 | Alu-Y | 2 | 1 | 289 |
| 887485 | 887748 | L1MD2 | 337 | 794 | 1072 |
| 887752 | 887779 | LOR11 | 366 | 395 | 422 |
| 888253 | 888318 | LINE2 | 362 | 2440 | 2505 |
| 888385 | 888548 | LINE2 | 362 | 2579 | 2739 |
| 888865 | 888893 | LOR11 | 366 | 394 | 422 |
| 889006 | 889296 | Alu-Jb | 2 | 5 | 290 |
| 889446 | 889548 | Alu-Jo | 2 | 188 | 290 |
| 889549 | 889677 | L1PB3 | 358 | 770 | 897 |
| 889842 | 890133 | Alu-Sq | 2 | 1 | 290 |
| 890515 | 890797 | Alu-Sz | 2 | 1 | 283 |
| 890858 | 890972 | L1ME2 | 341 | 769 | 885 |
| 890986 | 891024 | LOR11 | 366 | 396 | 434 |
| 891028 | 891063 | LTR66 | 266 | 173 | 207 |
| 891126 | 891536 | LINE2 | 362 | 1980 | 2452 |
| 891545 | 891670 | LTR16A1 | 382 | 9 | 128 |
| 891688 | 891963 | LTR16A | 381 | 146 | 429 |
| 892907 | 893013 | LINE2 | 362 | 2636 | 2747 |
| 893851 | 893924 | MLT1L | 119 | 47 | 119 |
| 894528 | 894849 | Alu-Sx | 2 | 1 | 290 |
| 895825 | 895903 | LINE2 | 362 | 2592 | 2664 |
| 895912 | 896083 | MER20 | 317 | 46 | 216 |
| 897067 | 897299 | MER20 | 317 | 2 | 217 |
| 897492 | 897624 | Alu-FLA | 2 | 2 | 136 |
| 897977 | 898261 | Alu-Sc | 2 | 1 | 290 |

The lengths of the non-repetitive intervals were calculated from these data. For example, a non-repetitive interval of 5358 bp was determined between coordinate positions 853779 and 859137 which delineate the boundaries of adjacent ALU-Sz and ALU-Sx repetitive elements. Next, the non-repetitive intervals were sorted based on their respective lengths. Four of these non-repetitive intervals were selected for probe development, namely the above-referenced 5358 bp sequence, a 3847 bp sequence (coordinates 819757 and 823604), a 3785 bp sequence (coordinates 843271 and 847056), and a 3130 bp sequence (coordinates 874990 and 878120).

In the next step, the Long PCR technique was used to amplify portions of the four identified single copy intervals. The technique followed for amplification of the 5358 bp interval is described in detail below. Similar techniques were followed for amplification of the remaining three single copy intervals.

Probes of maximal length were desired for FISH experiments. However, in order to optimize the PCR reaction that generated these probes, other constraints had to be met, which resulted in amplification products somewhat shorter than the entire non-repetitive sequence interval. The Prime computer program was employed to optimize the selection of primers for PCR (Genetics Computer Group software package, Madison Wis.). The PCR primers which were optimized for Long PCR were constrained as follows: size of 30–35 nucleotides; GC content of 50–80%; melting temperature of 65–70° C.; the primer was not permitted to self-anneal at the 3' end with hairpins of greater than 8 nucleotides; the primer was not permitted to self-anneal at any position with greater than 14; and the primer was permitted to anneal only at a single position in the target sequence and primer-primer annealing was limited at the 3' end to less than 8 bp and at any other point less than 14 bp. In addition, certain constraints were applied to the amplified PCR product in order to optimize Long PCR: length of 5100–5358 nucleotides; GC content of 40–60%; melting temperature of 70–95° C.; difference in forward and reverse primer melting points less than 2° C. This yielded a possible 517 forward primers and 382 reverse primers, and a total of 928 possible products. The Prime program using the foregoing constraints rank ordered potential primerpairs. The top ranked primers were selected for synthesis, as set forth in the following Table 2. These primers were commercially produced (Oligos, Etc., Wilsonville, Oreg.).

TABLE 2

| Gene | Chromosome Band | GenBank Accession No., Chromosome Genomic Sequence | Coordinates of Longest Single Copy Intervals, Beginning/End | Forward PCR Primer Coordinates, Beginning/End | Reverse PCR Primer Coordinates, Beginning/End | PCR Primer SEQ ID Nos., Forward/Reverse | Probe Length (bp) |
|---|---|---|---|---|---|---|---|
| HIRA | 22q11.2 | NT_001039 | 853779/859137 | 853946/853975 | 859116/859085 | 429/430 | 5170 |
| HIRA | 22q11.2 | NT_001039 | 819757/823604 | 819901/819933 | 823592/823559 | 431/432 | 3691 |
| HIRA | 22q11.2 | NT_001039 | 843271/847056 | 843602/843631 | 846946/846915 | 433/434 | 3344 |
| HIRA | 22q11.2 | NT_001039 | 874990/878120 | 875226/875257 | 878074/878042 | 435/436 | 2848 |

Using these primers, a Long PCR reaction (50 µl) was performed using 1 microgram of high molecular weight genomic DNA (purified by phenol extraction) and 200 µM of each oligonucleotide primer to amplify the 5170 bp probe. Specifically, high fidelity DNA polymerase (LA-Taq, Takara Chemical Co.) was employed using the following thermal cycling protocol:

Step 1—94° C.—5 minutes
Step 2—98° C.—20 seconds
Step 3—65° C.—7 minutes
Step 4—14 times to Step 2
Step 5—98° C.—20 seconds
Step 6—65° C.—7 minutes+15 s/cycle
Step 7—14 times to Step 5
Step 8—72° C.—10 minutes
Step 9—0° C.
Step 10—END Because amplification of the 5170 bp probe is less efficient than amplification of shorter fragments, the initial PCR reaction did not yield sufficient quantities of probe for multiple hybridization experiments. Therefore, a 4 µl aliquot of the original DNA amplification reaction was reamplified using the following protocol: Step 1—94° C.–1.5 minutes, followed by Steps 2–10 of the original PCR reaction. Sufficient quantities of the 5170 bp probe were obtained. An alternative to reamplification is to increase Step 7 by at least 10 cycles.

The amplified product was then purified by gel electrophoresis followed by column chromatography. First, the amplified product was separated on a 0.8% Seakem LE agarose gel (FC Bioproducts) in 1×modified TAE buffer. The gel was then stained with ethidium bromide and visualized with UV light. The fragment corresponding to the correct interval size was excised in an Ultrafree-DA spin column (Millipore) and centrifuged at 5000 g for 10 minutes. The DNA was recovered in solution and precipitated in 1/10 V NaOAc and 2.5 V 95% EtOH (overnight) at −20° C. The precipitated DNA was then centrifuged, rinsed with cold 70% EtOH, air dried and resuspended in 20 µl of sterile deionized water. The DNA was checked on a 0.8% agarose gel (Sigma) to determine DNA concentration.

The detailed probe labeling, hybridization, removal of non-specifically bound probe, and probe detection procedures are described by Knoll and Lichter, In: Dracopoli et al. (eds), "Current Protocols in Human Genetics Volume 1", Unit 4.3 (Green-Wiley, New York,1994). Briefly, in order to label the probe, a standard nick translation reaction was carried out (Rigby et al., J. Mol. Biol., 113:237–251, 1977) using digoxigenin-11-dUTP as the label. This yielded a series of overlapping 300–500 bp labeled fragments, which together comprised the 5170 bp probe.

The labeled probe fragments were then precipitated by adding 1/10 V NaOAc plus 2.5 V 95% EtOH and carrier DNA (overnight, −20° C.). On the following day, the precipitated DNA was centrifuged, lyophilized, and resuspended in deionized sterile water at a concentration of 125 ng/20 µl.

A comparison set of hybridizations were carried out with normal denatured human metaphase chromosomes, using the labeled probe fragments with and without blocking nucleic acid of the type described in U.S. Pat. Nos. 5,447,841, 5,663,319 and 5,756,696. Twenty µl of resuspended labeled probe was then lyophilized and resuspended in 10 µl of deionized formamide and denatured for 5 minutes at 70–75° C. to yield single-stranded nucleic acids. For comparison, probes were pre-reacted with purified repetitive DNA by adding 125 ng (or 20 µl) of labeled probe to 10 micrograms of $C_0t$ 1 DNA (Life Technologies) and lyophilizing the mixture. This mixture was then denatured for 5 minutes at 70° C. followed by pre-reaction (or pre-annealing) for 30 minutes at 37° C. to convert the single stranded repetitive sequences in the probe to double stranded nucleic acid. This disables the hybridization between the sequences and the chromosome as target DNA template.

Subsequently, the denatured probes with or without purified repetitive DNA (i.e., $C_0t$ 1) were mixed with 1 V prewarmed hybridization solution (comprised of 4×SSC/2 mg/ml nuclease free bovine serum albumin/20% dextran sulfate/30% sterile deionized water) and overlaid onto denatured target DNA. The chromosomal target DNA, fixed to a microscope slide had been denatured at 72° C. for 2 minutes in 50% formamide/2×SSC. A coverslip was placed over the probe hybridization mixture on the slide, sealed with nail polish enamel to prevent evaporation and placed in a moist chamber at 39° C. overnight.

Figure 2:

Following hybridization, non-specifically bound probe was washed off with varying stringencies of salt concentration and temperature. The labeled probes, pre-reacted to disable repetitive sequence hybridization, and the probes without such pre-reaction were detected with rhodamine-labeled antibody to digoxigenin-11-dUTP, using a conventional FISH protocol (Knoll and Lichter, 1994). Chromosomal DNA was counterstained with DAPI. The cell preparations on microscope slides were then mounted in antifade solution (Vectashield, Vector Laboratories) and visually examined using a fluorescence microscope with the appropriate fluorochrome filter sets. FIGS. 1 and 2 are photographs illustrating the results of the comparative hybridizations, where FIG. 1 is the hybridization with the blocking repetitive sequences, while FIG. 2 is the hybridization without pre-reaction with purified repetitive DNA. These photographs depict hybridization to both HIRA alleles on two normal chromosome 22q11.2 regions. A comparison of the photographs demonstrates that the presence of the blocking repetitive sequences is unnecessary using the probes of the present invention.

Figure 6:
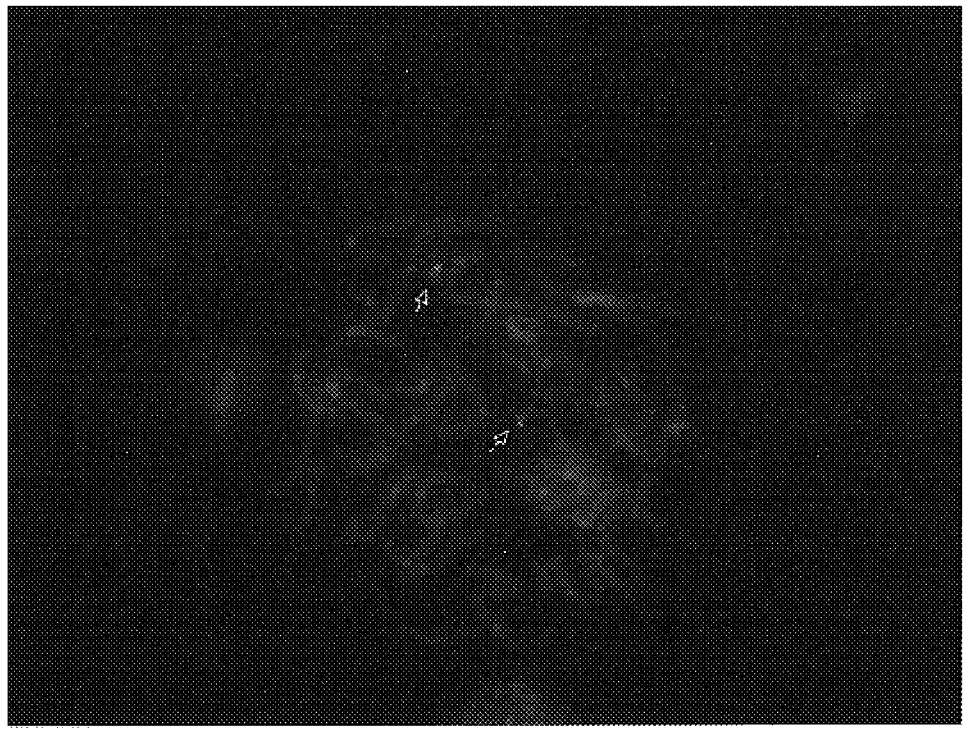
Figure 12:
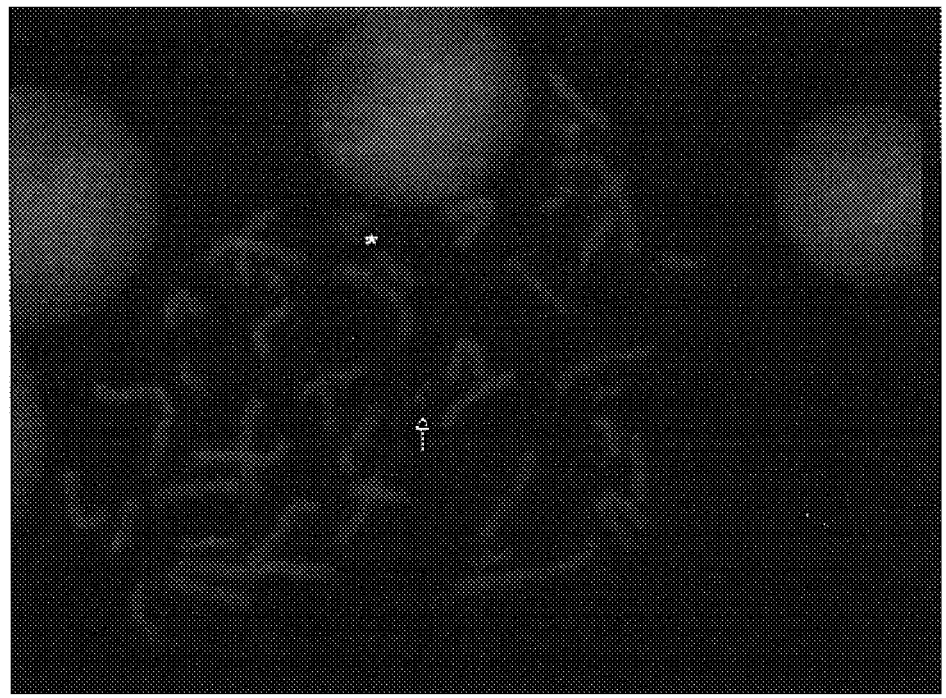

The remaining three probes identified in Table 2 were PCR-amplified and labeled as described above. These probes were used in a series of FISH experiments to determine the efficacy of the probes. Thus, all four probes were used together without pre-annealing of potentially repetitive sequences (FIG. 6), and a combination of the three shortest probes were used on cells from a patient affected with DiGeorge/VCFS with a previously confirmed deletion (FIG. 12). In the FIG. 6 photograph, the probe was hybridized to a single region of both chromosome 22s in a normal individual (arrows) In FIG. 12, only one chromosome 22 hybridized (arrow). The other chromosome 22, as indicated by a star, has a deletion of this region and does not hybridize to the probe.

EXAMPLE 2

Development of NECDIN and CDC2L1 Gene Probes

Figure 4:
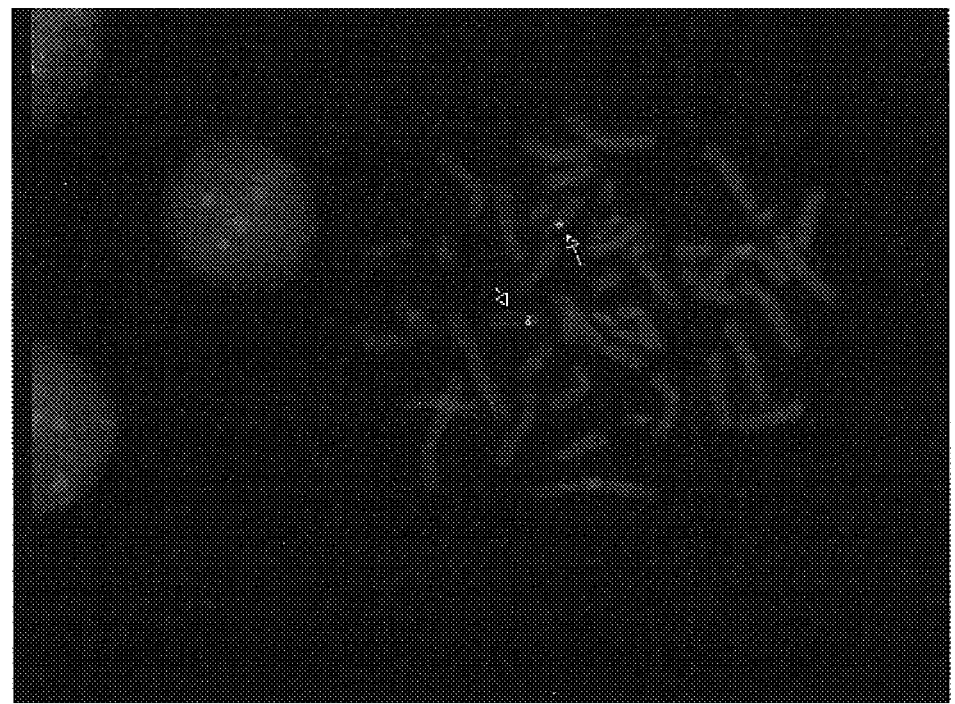
Figure 5:
Figure 11:

The techniques described in Example 1 were used to develop a series of probes for detecting known genetic disorders on chromosome 1 (Monosomy 1p36.3 syndrome; Slavotinek et al.; *J. Med. Genet.*, 36:657–63 (1999)) and on chromosome 15 (Prader-Willi and Angelman Syndromes). Approximately 70% of patients with Prader-Willi or Angelman syndrome exhibit hemizygous deletions of the sequence containing the NECDIN gene (Knoll et al.; *Amer. J. Med. Genet.*, 32:285–290 (1989); Nicholls et al., *Amer. J. Med. Genet.*, 33:66–77 (1989)). The presence of excess copies of this gene is diagnostic for an abnormal phenotype in patients with interstitial duplication or a supernumerary derivative or dicentric chromosome 15 (Cheng et al., *Amer. J. Hum. Genet.*, 55:753–759, 1994; Repetto et al., *Am. J. Med. Genet.*, 79:82–89, 1998). The following Table 3 sets forth the deduced single copy intervals, PCR primer coordinates, SEQ ID Nos., and the lengths of the resultant probes.

sequences; FIG. 4 is a comparison, without pre-annealing. In FIG. 11, all three probes were used in combination, on metaphase cells from a patient affected with Prader-Willi syndrome known to harbor a deletion of 15q11q13 sequences on one chromosome 15. The normal homolog is indicated by an arrow and shows hybridization to a single chromatid. The location of the deleted chromosome is indicated by a star. It does not show hybridization with the probe.

The foregoing examples demonstrate that the mixed combinations of DNA fragments give identical hybridization results, as compared with the fragments when used individually. This establishes that none of the fragments used individually or in combination will hybridize to any other location in the genome and hence, are free of repetitive sequences. This provides an additional confirmation of the validity of the present method for the design and production of single copy genomic probes.

Figure 7:
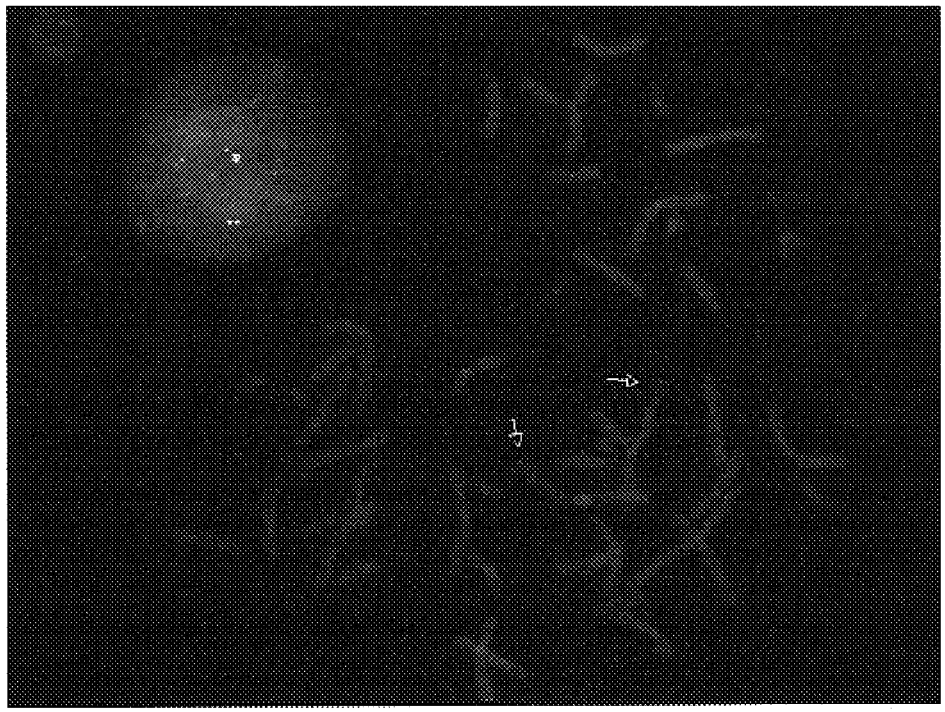

Current use of commercial and research genomic probes to detect these disorders requires that hybridization of repetitive sequences be disabled prior to annealing of the probe to metaphase or interphase chromosomes. This increases the number of steps required to perform the protocol and could potentially increase the chances of procedural errors occurring, any of which would be unacceptable in the clinical diagnostic laboratory. The results present in FIG. 7 are comparable to those obtained using related commercially available genomic probes to detect these abnormalities. Hence, these probes will be useful in the detection of these genetic disorders. The probes themselves or in combination with other solutions necessary for hybridization and detections can be provided to clinical laboratories as kits for detection of these genetic disorders.

TABLE 3

| Gene | Chromosome Band | GenBank Accession No., Chromosome Genomic Sequence | Coordinates of Longest Single Copy Intervals, Beginning/End | Forward PCR Primer Coordinates, Beginning/End | Reverse PCR Primer Coordinates, Beginning/End | PCR Primer SEQ ID Nos., Forward/Reverse | Probe Length (bp) |
|---|---|---|---|---|---|---|---|
| CDC2L1[1] | 1p36.3 | AL031282 | 8823/17757 | 9137/9167 | 13960/13931 | 444/443 | 4823 |
| CDC2L1[1] | 1p36.3 | AL031282 | 8823/17757 | 13028/13057 | 17752/17720 | 445/446 | 4724 |
| NECDIN | 15q11-q13 | AC006596 | 94498/99152 | 94501/94535 | 98667/98601 | 439/440 | 4166 |
| NECDIN | 15q11-q13 | AC006596 | 68031/75948 | 72122/72156 | 75666/75637 | 437/438 | 3544 |
| NECDIN | 15q11-q13 | AC006596 | 76249/79221 | 76608/76639 | 78898/78867 | 441/442 | 2290 |

[1]Two sets of primers were used to generate two DNA probe fragments which, together, spanned the entire interval.

Figure 8:
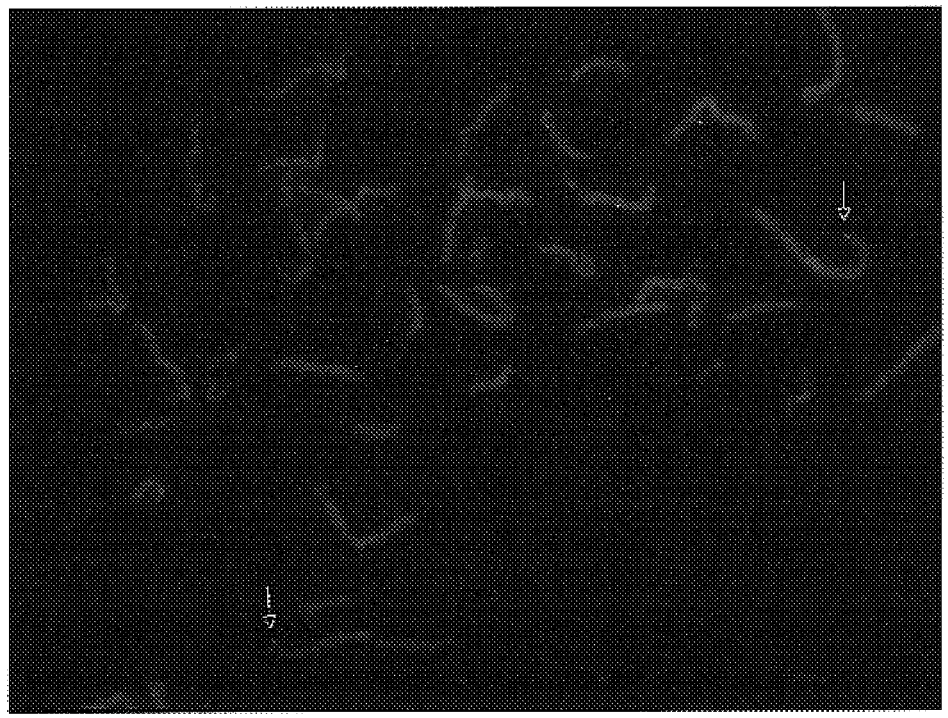
Figure 9:
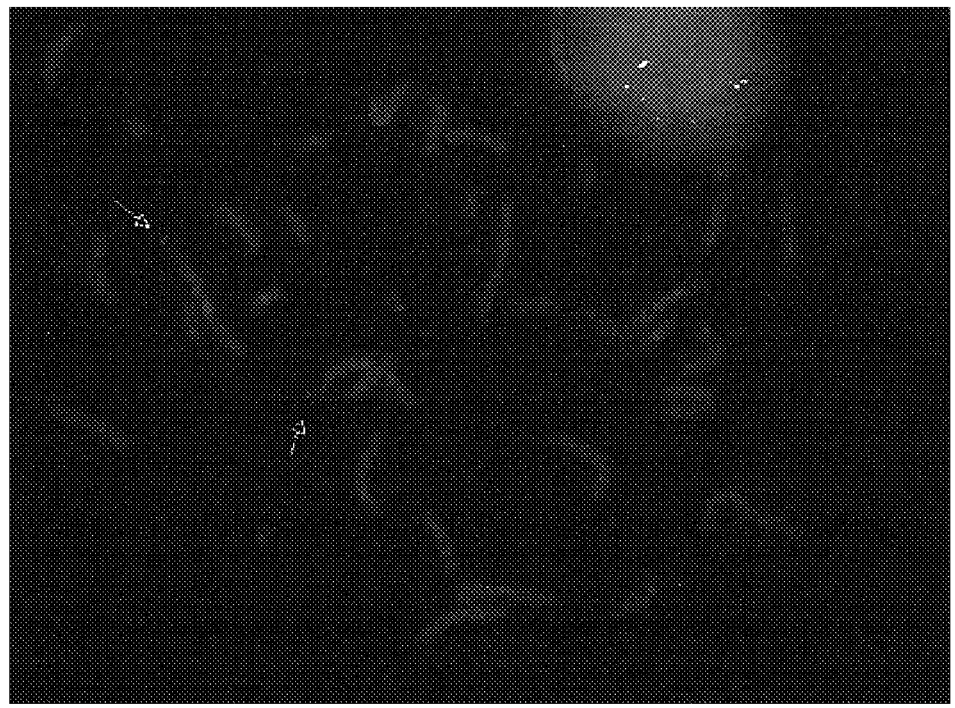
Figure 10:
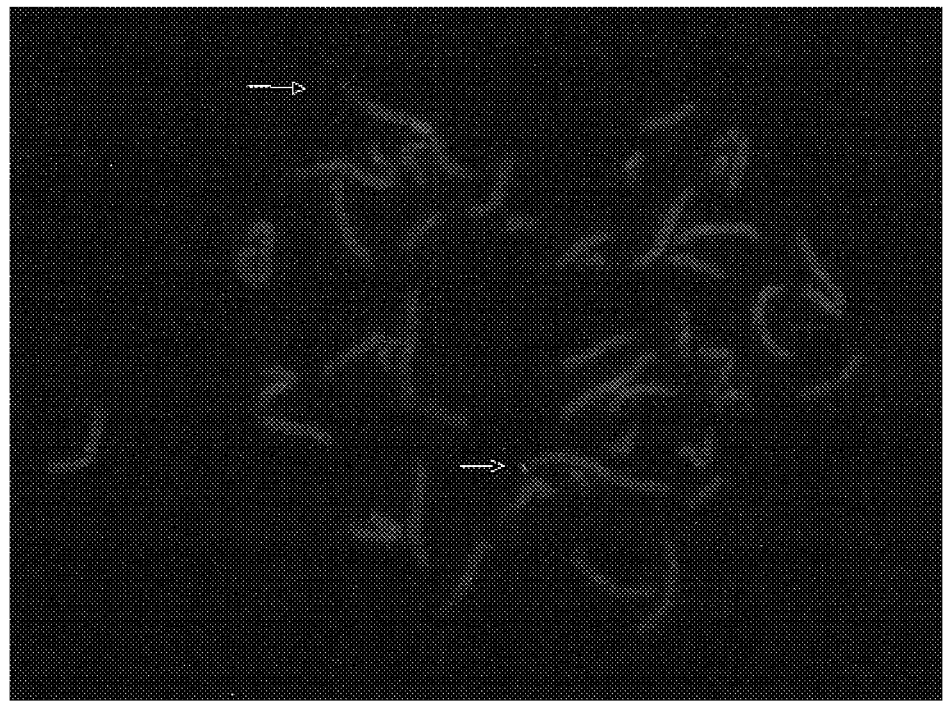

PCR-amplification was performed using the CDC2L1 primers in Table 3, and products were labeled, hybridized and detected as set forth in Example 1. The labeled probes were used in a series of FISH experiments, with images of the hybridizations provided as FIGS. 7–10. In the experiment shown in FIG. 7, the longest 4823 bp probe was employed and potential hybridization repetitive sequences was disabled by pre-annealing with purified repetitive DNA. As a comparison, the same probe was used without pre-annealing of purified repetitive DNA (FIG. 8). The hybridizations appear identical demonstrating that the presence of purified repetitive DNA to block repetitive sequence hybridization is unnecessary. In both instances, the chromosomes with one or both chromatids hybridized are indicated by arrows. In the experiments shown in FIGS. 9 and 10, the 4823 bp and 4724 bp probes were employed, with (FIG. 9) and without (FIG. 10) pre-annealing of the purified repetitive DNA. Again, pre-reaction of the purified repetitive DNA is shown to be unnecessary using the probes of the invention.

Figure 3:

The NECDIN probes were also used in a series of FISH experiments, as shown in FIGS. 3–5 and 11. In FIG. 3, the 3544 bp probe was used on metaphase cells from a normal individual, with pre-annealing using purified repetitive The probes developed from genomic sequences other than those presented as examples cited herein can also be utilized to detect inherited, sporadic, or acquired chromosomal rearrangements. These rearrangements may corresponding to numerous other known genetic abnormalities (including neoplasias) and syndromes besides those examples given above. Hence, the present invention can be useful for producing probes from genomic regions for which probes are not presently commercially available.

In principle, the present method can be utilized to design, develop and produce single-copy genomic probes for any genomic interval where the DNA sequence is available and where a comprehensive set of repetitive sequence elements in the genome has been cataloged. Such catalogs are currently available for genomes for the following organisms (http://www.girinst.org): *Homo sapiens, Mus musculus, Arabidopsis thaliana, Canorhabditis elegans, Drosophila melanogaster*, and *Danio rerio*.

All references cited above are expressly incorporated by reference herein. In addition, the subject matter of Disclosure Document #471449 filed Mar. 27, 2000, is also incorporated by reference herein.

SEQUENCE LISTING (479 sequences)

SEQ ID NO: 1 - DNA, 171 bp, Homo sapiens
  repeat_region (1)..(171): ALR
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aattctcagtaacttccttgtgttgtgtgtattcaactcacagagttgaacgatcctttacacagagcagacttgaaacactctttttgtggaatttgcaagtggagatttcagccgctttgaggtcaatggtagaataggaaatatcttcctatagaaactagacagaat

SEQ ID NO: 2 - DNA, 290 bp, Homo sapiens
  repeat_region (1)..(290): Alu
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 0
  ref <306>: PAGES: 286-291
  ref <307>: DATE: 1992-10-__
  ref <308>: DATABASE ACCESSION NUMBER: Database of repetitive elements repbase
  ref <309>: DATABASE ENTRY DATE: ____-__-__
  ref <309>: DATABASE ENTRY DATE: 1996-01-26
ggccgggcgcggtggctcacgcctgtaatcccagcactttgggaggccgaggcgggaggatcacttgagcccaggagttcgagaccagcctgggcaacatagtgaaaccccgtctctacaaaaaatacaaaaattagccgggcgtggtggcgcgcgcctgtagtcccagctactcgggaggctgaggcaggaggatcgcttgagcccgggaggtcgaggctgcagtgagccgtgatcgcgccactgcactccagcctgggcgacagagcgagaccctgtctcaaaaaaaa

SEQ ID NO: 3 - DNA, 68 bp, Homo sapiens
  repeat_region (1)..(68): bsr
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gatcagtgcagagatatgtcacaatgcccctgtaggcagagcctagacaagagttacatcacctgggt

SEQ ID NO: 4 - DNA, 382 bp, Homo sapiens
  repeat_region (1)..(382): cer
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ctgcagaacactacttccagggtctaaatgtctgtccttcacataggattccagaacactgctacgagagtgtgaatgtttgtccttcacatagcatttcacaactgccatggtctgaatggttgtccctcacatagtattccagaacactgctatgagggtctgaatgtttgtacctcacataggattccagaacactgctatgagggtctgaatgtttgtacctcacataggattccagaacactgctatgagtgtttgaaagtttgtccctcacataggattccagaagactgctgctggggtctgaatgtctgtccctcacatcggattccagaaccctgctgctggggtttgaatgtctgtccctcacatagaattc

SEQ ID NO: 5 - DNA, 2739 bp, Homo sapiens
  repeat_region (1)..(2739): charlie1
  misc_feature: n is a, c, g or t
  ref <308>: DATABASE ACCESSION NUMBER: Database of repetitive elements (repbase)
  ref <309>: DATABASE ENTRY DATE: 1996-01-26
cagcggttctcaaagtgtggtccgcggacccctgagggtccccgagaccctttcagggggtccgcgaggtcaaaactattttcataataatactaagacgttatttgcctttttcactctcattctctcacgagtgtacagtggagttttccagaggctacatgacgtgtgatgacatcatcgctctgatggctaatggaatgtgtgcttgtgtattcttgtgttttctaaaatttttaaggtagtaggtttagggtataaatatgtaggttttcagagattaactcagtttsttcttagcacttctaccgtgctcttactagctatcttcagttatacctgctataatctttgtaacctcattatcgtccaataaatcattattttraaatcctaaagttttcctcgwgcctatgtgaaaacacaagaagcaagtactacttgtaaaacttgcttgcaataacattttgaaaatttcccaaatgtttaaattttatcgacaacatatagaatttaatattttattctaaaataaaaatttatttataawgtttttcctatatttaagggtggattgttggcttaaaaaagggagattagaagactcgctttctcaacccacagctgcamcatctatgtctaaagatgctgaaatggacataccagcaagttctctgattcctcatggaarggaggaatctactccaaagaaactgggcgaaactgtaaataaaaaacaaaaatatgataaaagctatcttctcagctttatagatgttaataatttaccttattgtgtcttatgcaacagaacattttcgaatagtattatggtgccagttaagttgcggcatcattttgagaccaatcattcagagtttaaagaaaaaggaattaaatattttaaacgtagatgtgatgagctctttaaaagccaaaaattgtttgttgcagcttttcaaactagaaatgaaaaagccactgaagcatcttacaggataagttgccayattgcattggctggagaagcmcacacaataactgagagactaataaagcctcgaacagttgacattgctgaatgcctgctggatgaaaagtcagtaaaagaaatcatagcactgccactttccaatgatacgataactcgtcaaattaaagatttagctgcaaacatgaagaccgagttaatatntcatctgcagaattgtacttttgccttacaaatggacgaatctacagatgtkgctagacttgctgtgttgcttgcgttcgtctggtatcagcaccaactgatcatcgaagaacttcttttatgtgaattcttggcaacaaacacaagtggtgatgaaatattcaaagtgttgaatgacttttttgaatctcatgatttatcctggaacaactgtgttgacatttgcactgatggtgcaaaagcaatggtgggtaaaactgctggcgccttagcacgaatcaaggcagtggcaccaaactgtactagtagtcattgtattcttcaccgccacgcactcgcagtwaaaaaaatgccagtttcacttaagaatgtccttgatgaagcagtaaaaattattaattttattaaatctcaacccttgagtacacgtctttttaatattctgtgtgacaaaatgggaagtacgcataaagcacttctgctgcataccgaagtacgatggttgtctcgaggaaaagcacttgtgcgattgtttgagttgcgagctgaactagctgcttttttcatggaacaccatttttacttgaaagaacgactgacagacaaactatggttattcagacttgggtatttggcagacattttctcgaaaatgaacgaagtgagcctgtcacttcaaggaaaacaactgacagtatttgttgccaatgataaaattcgagctttcaagcgaaaattagaattttggaaaacttgtatccgccaccgtgagcttgacagcttcccaatacttaaagacttttctgatgagatcggtggtgatattaacgaatgtgattttttgatattgtataatgaaatgtgtcaacatttggaagatctgcataactcagtgaaccaatattttccaaatgaccaatgcatgatgttacaaaatcatgcatgggtaaaagatccattcaaagtgcaagatagaccaatggattttaatgtaacagagtatgaaaagttcattgatatggtttcagattccacattgcaactaacctttaagaaactaccacttgtcgagttttggtgtagtatcaaagaagaatatccacaattatctgaaaaggctattaaaatactcctcccttttccaactacatatctgtgtgaggccagattttcttcatatacttcaaccaaaacaacatatcgcaacagattgaatgcagaagcagatatgagaatccagctgtcttctattaagccagacattaaagagatttgcaaaaatgtaaaacaatgccactcttctcactaaatttttttgttttggaaaatatagttatttttcataaaaatgttatttatgttaacatgtaatgggtttattattttwaaatgaatwaataaatattttaaaaatttctcagttttaatttctaatacggtaaatatcgatagatataacccacataaacaaaagctctttggggtcctcaataatttttaagagtataaaggggtcctgagaccaaaaagtttgagaaccgctg

SEQ ID NO: 6 - DNA, 2760 bp, Homo sapiens
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagtggtcttcaaactggggtatacatacccctgggggtacatgaagactttccaaggggtatgcgggcacggatagttttaagggaatcaatttccagatcctcarcttccatatgtactctttcctaaaactgatctgcctgagaacgcgcctgtggcgagggcctgccgnctttcccacttcccctttcacgatcgcccttctcccactttacaaaagaaaggcatacctctcacccatcccgaatcttactatggtgcattgccctggggtgtaaaaacctccggggcaccaaacaaagggacaattcgaaatactggtgttggtgaagcctcctttaatcaaggcaccataarcccgnngtacagttttatgtcttccctggctttayaaatatttctgttaagggtaaagcatgatgttggaacaaggtactttggcycatgttggggtgttctgaattcagatatatcntagagtggggtggtgggagtgatgacgatttttncttgacgatgttgcttcttccatcnctattnacaaagaatacattgctcctgaggaagagtcctgagagcaaagcaaagagaacattgntaagaaatggcgaagatggcagtgcnttatttcatccaggtgacaaactcatggcgaggtctatctatctgakagttggaatattcaagatwtgkaaaaggcattctgggaaataccaatcngctacgaagcatgcctcctctgcactttcaccattctcagtantgagaaagagcttggtgagtactctcattcacctgcgtcttagtctgkgtctcagttgcatattttgcatgatttcaaggmggtggaggcgaaaagctctgcaattacttctaacagatcaacattacattttcaagtaaaaggaacatatattggaggtaagttmrtgtatkctattttcttgaacatttattcagattmataggagaaacattttcattaacttttgccaaagatttctagatagtgtaaatatatttttctatttaggcamaagtctcctgctcactgtcactcatgaacmacttctctgttcatttattnattcctaccatatacttactagagttagattaanttaacaggaatatgttgcagattctactgtaantaatgcacwtaatagcagtcagtaatataacttttgtaaacccatanttattaatgatccaatancttctctctcnttttgctgwcgatttccacaaagtagattaaactgtactcttaaaagcagaacattcacttatgtacgagtgcaggacagaatgttccaaaatgcaatstagaatgcgatgcccwgaacttcagaaaaccagcttcacttaattaggattaatttctcccgctcggangctaatatactgttttanttctgtcaaatgnatnattataagtaataatttttnacaataacgaaattantantatatacatgaatannctcaagtgtccgtccctctgtcatatttttaaaatgcatttngagacgttcttaaaaaatgaaatwtggtattgtntataggtctctgttcgtagtcgakgagamaagtccccaaatncacaatttacaatttttcgwtttttccaactccttccatgtatattgaggtccataagcaaggtgcctctaagtgaaagagtagcaggnataattaatagtcatttgataagtcttggtgaagccttttgggtatacttcctagaaactgagaaagtgaatgactctaatgactgggtaacaaatccttttgcaagtcaggtggtttccaattctttgctttcaacaaaattgaaggaggacctaatcgagttgtcagctgacagatcattaaaaataatttttgatgatagatcaytatgtgatttttggcatataactcggaaggagttcaaagaattgagtgacattgctataacaaaactccttccattcccatctacttatttatgtgaacaagrtttctcagcgcttacatctataaaaatgaaaaataggaatagaattgatgctgaactctgtctcattctagcaataagtaatattcatccacggatacatgaactaattggggaaacaaggccccatccatctcattaagagatgcatttccaataaaattttactttttatgtttawtatttatcaaaatttgtaatatgtttatgttgttttgatcaattgtatattaataataattgtaatgataactcaatccagaagaaaawttttaacacttagagccttatggtcanarkaaatataaaaaattaaatttcaatttatatacatatttttgttgcagagaagtatgatagggtgatcaataaaagactttcaagcataaaaatatattacattaggataaaattctgtgggggaagtggaatggaaatacgagttcaaggagaaaaagagaacaatgtaaaatttccgactgttaaagaagagcttgctcatgtattttttaaatggatgatggtgggtatcaaatcgctatggtatttagattccattggatacatttaaaagagtgatgtaacagttttattttaaaatgtcaatatttacaatatgccagaaattacatcctttgcaactatttaaacttatgatgaaaaattttagatgtcaacttaaaaatgtgcgagggrgtacatagtttttcaaaattcttttaggggatacgcaagcaaaaawgtttgaagaccactg

SEQ ID NO: 7 - DNA, 2710 bp, Homo sapiens
  repeat_region (1)..(2710): charlie3
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database for repetitive elements (repbase)
  ref <309>: DATABASE ENTRY DATE: ____-__-__
  ref <309>: DATABASE ENTRY DATE: 1996-01-26
caggggtccccaacccccgggccacggaccggtaccggtccgtggcctgttaggaaccgggctgcacagcaggaggtgagcggcgggcgagtgagcgaagcttcatctgtakttacagccgctccccatcactcgcattaccgcctgagctccacctcctgtcagatcagcggtggcactagattctcataggagcgcgaaccctattgtgaactgcgcatgcgagggatctaggttgcgcgctccttatgagaatctaatgcctgatgatctgaggtggagctgaggcggtgatgctagcgctggggagcggctgcaaatacagattaacattagcagagaggtttgactgcacagagaccataataaatcaattgcttgcagactcatatcaaaaccctatcagtgagtggcaagtgacaattaagctgcatctggtggcaggctttatagtggcaagtgagttgatgtacttcaattgtacagctgcatctggtggcaggctttaagtcagaatccgacacttattttagtccgcgcgtggcctgctcattattttatttaccacttccatccgcgcctctttcccgcactgcgcacttgtctcagtcacagttttggtaagcccacaagctaaccctagccaaaatgagtaaaaaacaaacgtcactggagagcttctttgaaaagggggaaagacccaatgatgagacagcagaagactctaagactgccaamaaaaanaangctgcatttaaaagaaaataccaagagtcctacttaaattacgggttcattgcaacaggtgattcacattctccaagcccgctttgtataatatgtggtgaccagctatccaacgaagccatgaaaccttcaaaactgcttcgccacatggagaccaagcaccctgcattagaagacaagcctttggagtttttcaaaagaaaaaantgtgaacacgaagaacagaagcaattattgaaggccaccacttcatcaaatgtgtctgcactgagagcatcattcttagtggctaaccacattgctaaagctaagaagccctttactgttggtgaagagkktgatcctgcctgctgccaagssacatttgtcatgaactctwaggagasgmtgcmsttcaaawggtggcatgtgttcmtctttcakctttcagccaccacaacmagacgaactggtgaaacagcagaggatattgaggcacagttgttagagaggatkaatgagtcaccgtggtatgcaatccaggttgamaagtctaccagtgttaacaacaakgmaacaakgcttgcttttgtgkgatatatttttcaggaggatgcgcawgaggatatgttatgtgcacttttgttgccaaccaacaccacagctgcagaattattcaagtctttgaatgattacatatcaggaaaactgaattggtcattttgtgtcggtatatgcacagacagagtggctgccatgactggatggctttctggtttcactactcgggtcaaagaggtcgcttctaaatgtgagtctacacactgcgtcatccatagagaaatgctggctagctggaaaatgtcacctgaacttagcmacgttttgcaggatgtsmttaaaattatcaaccacattwaagtacatgcccttaactcacatctgttcgcgcagctctgtgaggagatggacgcagngcacacacgtcttctcttatacacagaagtgagatggctttctaaaggtagatcactggccagagtttttgagttacgagagccgctccagagatttcttttagaaaaacagtcaccactggcagcacatttcagtgacatagaatgggtcgcaaaacttgcttacttgtgtgacatattcaacctgctcaacgaactcaatctgtcacttcaggggagaatgacaactgtgttcaagtcggcagataaagtggctgcattcaaagccaaactggaattatgggggcgacgagtgaacattgggatttctgacatgtttcaaacattagcagagattttgaaagagactgagccagggccttctttctcccagctggtgcatgatcacctatctcagctttcaaaagagtttgagcattacttcccaaccacaaaggaccccagaactgggaaggaatggatccgcgacccatttgtgaataagccagstgaatcgactttgtccgtgctagaagaggatcaactgcttgagactgcaaatgacggtggccttaaaagtatgtttgagacaacttcaaatctccatacattctggattaaagtcaaagcggaatatcctgagattgccacgaaagcactgaaaagcctgcttccatttccagcatcctatctttgtgaagcagggttttctgcagtgacagcaaccaaaacgagattacggagtagactggacataagcaacacacttcgggtgtcgctgtctcccatcacccccagatgggaccgtctagttgcaggaaaacaagctcagggctcccactgattctacattatggtgagttgtrtaattatttcattatatattacaatgtaataataatagaaataaagtgcacaataaatgtaatgcacttgaatcatcccgaaaccatcccccccccctggtccgtggaaaaattgtcttccacgaaaccggtccctggtgccaaaaaggttggggaccactg

SEQ ID NO: 8 - DNA, 2585 bp, Homo sapiens
  repeat_region (1)..(2585): charlie5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ctgcgctgtccaatacggtagccactagccacatgtggctaytgagcacttgaaatgtggctagtgcgactgaggaactgaatttaatttntattattaatttaaatttaaatttaaaaactgaaacagtataaaatattttnccattaaacayaactttattgttttggtaggactatayttcactttaaccattgcatcgcgkcatatagatattgttgtattgtagtgcgcgtgtcgggtacgtgcgtcatttctagtattacacgtaaacacatcactaatctagtcggtgtcaayagattgattcagttcaaatgatttttttctrtgcactgatgtaacattgtaatgtgtttatttgaatattttatgcagacagcacgarttacagtgatacctatgtaaatcanaattggtaactaaattgaaatacttattattttmattattataaattattttcttagttaaaaataaatgtggamaaatttaaatttaaaacgaaggcatactactgatgtagaattgagtggagatgcagaagttagtactatgactagaatagtaaagaaacaagagactggaagaaggtatgtcgcaaatttcatgatgaatggcaattgcaatttgctgcggcagagcaaaacaaaaaagctgtttgttgtgwaaaaaatgttaaagataacaaagtagacaatattgagagacattttcagcaaatacatagtgaatttgataagtttctcctccaamagtcaaaaaagaattaacaaaattagtcgnctgaaatcagaattaaatgtccaacaaaaaatatttaataagttttaacagnatctaagcttgtaactttggccagctataaaatgtcttggattcttatwcaaaaaaagaaaacaattttagatggagagntggtaaaagaaattatttcagttatggaaattttgttagaaagttatgaggaaaagactaaaaagatattttacaaaaagtgaaagatcttcaattaagccaccaaacaattgcccgtagaatgnaagaccttkctaacaatatcaaagataaattgattcaaaatttgaaaaattgcaagkactttagctttagatgagtcgtgtgatatgagacactgcccaattaatactttgggtatgttttactcaaaggacttscaaatttacaaagaaatctgttgtcaattcatgncttaaaaaactcgtagcaaagattttttaaactcttttacatctnncaaagaakaatttcacttagatatgaaaaaaaatktttctatcacgncggatggtgctccagctatgttaggtcaaaaatccagatttattggaattttaaaacaagagactgatgttttccttattgcttcattccactgwatgatacatactgaaaatatttgtgctcagttttctgaagcagactccgtgaaaggwgtcatgggtacagttgttaaaattsttcagtatatacgtgcaaatgctgtgaatcaccgccagtttatggaactgttgaaagaaatagaagacaatgaatttaatgatcttgtgttctttgccaatgttcattggttgagtcatagaagagttttacaaagatttactgtactgttaactccaattcaagattttcttgaaacaaaaggaatgcttgccaaatattcaataatcaaagacaaaaaatggcantgtgatttacgttttctcaccaatatcacactgcatatgaacaagctaaatttgaagctccaaggaaaggaaaagcttatttgtgacctagctagacaggtataagaatttatgttgaaattgaaacttttcataatacaaatcaataataatgattttacacatttttctaacgtgaatcaatatgcagaagattttaattgtaattgacagtattatgtaaattggctgcaaaaactacaagaaaaatttgaagaatattttgttgatattgataaatttagaattgcttttcaatttatgcaatacccctttgaattcaatgttaataatactgagttgacacaagaattagtgaatttacttaacttggacagacatagttttgaaactgatatscttttgcttcaaagtaaaatcaattcttctaaaaaaatgaaccagttttgtcaatgtggatttaaatattaaaagaaaatgatttttgatactcgattcagttattggaaaacttttaagtatgtttggaacaacttgggtatgtgaatctactttttcaactgtaaattttatgaaatctaaatacagatcaagtatttccgatgaaaatttagcgtccgaattgagatgtgctgtaagtgtaaaatacacaccggatttcgaagacttagtatgaaaaaaagaatgtaaaatatctcattaataatttttatattgattacatgttgaaatgataatattttggatatattgggttaaataaaatatattattaaaattaatttcacctgtttctttttactttttttaatgtggctactagaaaatttaaaattacatatgtggctcgcattatatttctattggacagcgctg

SEQ ID NO: 9 - DNA, 2869 bp, Homo sapiens
  repeat_region (1)..(2869): charlie6
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttgcttgkgcccaktttcggkcwgtgatgcaagatangggaagctantgntaantggtgagtgctgcattacacagamgagaggggcggtaaaccgatgacatnagtttcccctnctccaattatttcccccagnctccccttatgcgntgccggntgacttaaggaacgaacaacctncgctagtataacgaaaatcagagggaatttgttttcattctaaggaaggagtttttacgtgccgcanctcagctctctncctgmcactttgttgttaaaacattgcaaaacgtnggttcaagtaggctagaagtgaattgtncagtgaagttttwttanttttgagattttcttgtttangtatgcttttwtgtttttcttttaactaatgtttgtgttttataaacatgtctganagcccaatgtggcaatttttgaaggcgagatgtgagatggaagaggaagwttctaggcctgggtctacggacaattctgataaggntagtgatgaaggattatagccttctgagtatncttcagtgtactagtgcaacaagggacacaganaaagtctatctttacgacgaaagccacttatcaakggttttatatgggctggtagtccaagctntcttattccattgtgnatcgtctgtggcaaacaacttanaaangcagcaatggctccagcaaaattgaaaaaacaccgtaacnataagtcacagctatttgacaagtaaagatgntgattatttttaaacggcnattggactctcaaaacaaacgagtaaagctttcgttcaaaaawnacntttagtgaaaaggctcaggaagcaagttatttagtagcagaacttattgcccagaaaaggaaaagncacanggttggtgagaacctaataatgccancatgtaaaattacagtgaatcaaagcctgggcaagatgcagtacgagaaattgaaaaggctccactctcaaacagtgcgataagntgacgtattgatgacatgtcacatgatgcnaaagaggttttgtgtaataaactganaaatagcagcttctctatccaggttgatgagtcaacagatttcactaatanatgtcatgctgtagcatttgtaagatttgtaaaggatggtgaaattcaagaaaacattttctgctgcaaagagctgcccaaaacaaggaaaggccaagatatanttaatgttttgacttcatatctgnaaaccagaggtctmagaaccgcgctgncatctacactnatngtgctccgtcagtanttggttcnatgagnnattttgcgttattaaataaaaaaagagaagkcctknttttcacattacagcacactgctttctccacagagatgctgatgtcaaaaactcttggagatacagtgaaagttctggataatgttacaaaactggttacctktattaacaaaggccaatttatgcgaaaatkttaaaaaaaaaaaangagacaacctnggcagasagcacataaacctcctgcaccatacagamatccggtggcttmkcagaggaagcgttctcwacagggtgtttgagttgaagggtgaattnccagagtactttcaawananggccggccagnttttgctgagtgctttggaatgaaaaatggctgcagaaagtcgnctacttngcagacatttttcatcacatgaaccagtgaacaagtctctgcaaggccctggagaaaatgntttkacttcgagtgacaagatttttggatttaaaaggaaactgaatctttggaaaagtcatgttgcaaaaggaaatcttgaaatgtttccnctgctgcttgggcttgagagtgaggaaggatatcagcmagtctcaagtcttactgaaaaccgcctggaagaaccgcagaacaaaacaaatggcattttccctcccnttcaacacaagtgtgtggctaggtgagggaccctttctctgaatctgctcagcctgagaacctggctttgagagaagagaaagnactttgtgagttgcggtctgatcgcacattcangatgagatttcctkatttttaccctaggcgcgttctggatcccwgtgamagaagmmtctcctgccactcgcaggaaagcagtgggcatktktgccgwgsttctcmacctcctkcatgtkgswkkaacaggctcgctcacgttttactaagnatcaagagcaagngcagaaatnnnctcatttcagttgaaaatgaaatctttatgtagctgtstsawgctcgatcmataattgagtgaaataaactgatcattaactatgtacaggtttcatgtgagagagtaacatatttttagtttaagtttcaaaaacaktgttttagtctatgcatgtgtaagcctaaaacagagatcaagaaactaatgtacatatataaaaatattattaacttctaggcctgtatttnnacctgatcatgtnactcagtaagaaatgttatnttttcaaagtcttatataaaattgtgcttaggctatattttattcatatttctttgcttacagttttantagctttactattcaacattgccaataaattttcatgttgtaaataacattaattaaaatcaatttanaatatttatttaaattaaatctaccgagcctacttttagaaaaattaaattccattttgnctcaagccagttatttaacagaaatttgcttgtcttatgtttttttaatttatgaaaangaaagaaagatwatttcaagaamagtaagctawgtctaacawcttttttctaggtaaaakttggmtagawggtmactcttakcttcwaatawggaagaatgtamaactagtcttgtatgtwcmatgt

SEQ ID NO: 10 - DNA, 2285 bp, Homo sapiens
  repeat_region (1)..(2285): cheshire
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggggtcggcaaactatggcccatgggccaaatctggcccaccgcctgtttttgtactgcccgtaaactaagaatggtttttacatttttaaatggttggaagaaaaatcaaaagaagartattttgtgacatgtgaaaattatatgaaattcaaatttcagtgtccataaataaagttttattggaacacagccacgcccattcgtttatatattgtctatggctgcttttgcgctacaacggcagagttgagtagttgcgacagagaccgtatggcaytctcattgcctttgcactsctgtttctraactataaccagtgttttgagtgccatgcatattactgtactgtaacattttwttytattattaatgnatacycatcatgtcaaaacaagaaaagaagagaaaagtrgactttgaatgttrcacttttaaggcacaatggagtatggattattttgttatggcaaagcattttattatgcaatgacactatagctgtgctaaatacaatatacattgacattaccagactaagcactcatcacartattcccaaatcacaggaaagcaatngtcagaaaaattagaaaatttaaaacagaatatctcatcacagcagaatttcttcacaaaawtaaaaaatnaaaatgaggctgnaaccaaagtaagtttctgagtggctcatttgttagccaaggaaggaagtcatttaccaatngtnaattaattaaatcatgttgattgcagcaggcatagaaatgtgtctagagaaaataaacttaaaactattagccttttgataagaagagttgcttaaagagttgaggacatcaataatcaattaaaaaggcaaatgrttttgagtggttttccttggctcttgatgagttgacaggtgttactgatactgctcagttgtttatttgaggagtcaatgctgagtttgaagtgctgaatagccttaatgaatagtctgtgtggaataattgcagacaagaatatttcaaaaagttgagaaaacactaattyagtacaacctgaaggaagtggaatctgctaagatgtgttaaaactgatggtggtaaaantatgtgtggagcagaaaaaagcttagttggacaaataaagctgtgaaaatgtaagntgtttaaagyctatggttatttattttattcatcagcaagtactttgtagaaaatatttgaatctatcatgtgatattgaaccagtagtgtcaacatttgctcttgtggacttaaccattgtcagttctntaaatttttgtcagaaatagaagctgaatatcctgacttgccctgctatacagyagtttgatggcttagnagtgctaaagctttattgntattttttgagctynggactgagattgaaatttttctgaatgagaagaactrctctcaaactrtttatcaaacactgagtggctttggaaattagcttttgctgcagatttgataatatttcttaataaattcaacctaaaattacaaggcaaaacagcacttatattgaaacttatactgttgtaaagtcatttcaatgrcaacaactattgtttgaatcacaagtaatgtcaagctgctttatatacttcccatgctatcaaaagttaaaacaaagaagtaagatctccattcccacacaatttgtagcagatatattttccaaactcaaactacagttccagcagcattttttggaccttgatgcaagtgcaaaggaaatwtccatttaactgtgcaattgagaagcttcctacctaaccttcaattggaatgattaatctgcaagtaatgacatgcaaatatcaagagaaaattctataaatgccttccaagcaatgaatatgctcaattnaaatcatatgctcgtgattgatatcantatttggcaatacctatcctgcgttgaaaataaaacattttcaaacatgaaatrtgttgcattacagattagcatttnaacagatgaacatttgcaatcrattttgatgatagggaacactaactttgaaccccaattaagcaaaatgttatcccwaaaaagaattccattcttctcattagtagacctgtattacaaaaaattgtactcaattattattwttattatattttgaatttcatcaataaaaattgtggaattttttctcttgttatataagtacctacataatatccttgattttgcctcttggcccgcaaagcctaaaatatttactatctggccctttacagaaaaagtttgccgacccctg

SEQ ID NO: 11 - DNA, 453 bp, Homo sapiens
  repeat_region (1)..(453): crl_hs
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gaggttcaacaaggccaagtgcaaagtgytgcacttgggttggggcaatcccaggtatrtatacaaactggggaactatgagcttggcagcagccctgtggagaaggatctgggggttctagtggatgawaagtttaatatgagccagcagtgtgctgttgctgccaaaaaagccaacagtatcctgggctgcattaanaagaggattgacagcagatcamgggaagtgattatacccctttacaatgccttggtgaggccacatttggaatactgcatccagttttggtcaccccaatrcaaaaaggatgttgagactttagagagagtacagagaagagcaacaaagatgatcagagggctggaggacctaacctatraggaaaggytgatggaattgggcttgtttagtttgragaagagaaggatgaggggagacatgatagcagcctt

SEQ ID NO: 12 - DNA, 75 bp, Homo sapiens
  repeat_region (1)..(75): ggaat
  ref <301>: AUTHORS: Jurka, J; Walichiewicz, J; Milosavljevic, A
  ref <302>: TITLE: Prototypic sequences for human repetitive DNA
  ref <303>: JOURNAL: Jurka, J; Walichiewicz, J; Milosavljevic, A
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ggaatggaatggaatggaatggaatggaatggaatggaatggaatggaatggaatggaatggaatggaatggaat

SEQ ID NO: 13 - DNA, 2986 bp, Homo sapiens
  misc_feature: n is a, c, g or t
  repeat_region (1)..(2886): golem
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagtcatgcgctgcataacgacgtttcggtcaacgatggaccacatatacgacggtggtcccataagattataatggagctgaaaaattcctatcgcctagtgacgttgtagtgcaacatatyactcaktactcacgcgtttgtggcgatgctggtgtaaacaaacctactgcgctgccagttgtataaaagtatagcacatacaattatgtacagtacataatacttgatagtgataataaatgactatgttactggtttatgtatttactatactatactttttattattattttagagtrtactccttctacttattaaaaaaaaaagttaactgtaaaacagtatgccgtgttagaccggcagcagccacatgcatctcgtgtttaccgcgtctcttgattgcatcattttctcttgtgcttgatttaatctcatgtgttttgttcatcacggctcctaagcgttcaaaatccacggctaatgttgccagtaagaggccacgtcgagtaattgagctggaaacaaaattaaaagtgattaaggaccgccgaaggtggaaaatcagtgatggttattgctcgccagacaggtatgtcccattcgaccatagctgccaccttgaagaacaagagcaaagtgacagaaactgttaaagggtctgcttcatcgaaggcgacgagaccaacaaatttgagaagtgccaacatcagatatggagaatatctgctaatgacctggattgaaaaccagacacagaaacatagctctctcagcaccacgacgaccacggccagagcaaaagggatatttttgatgttgaaagaaaaggctggacccgactgtgatatcgaatttactgctagttccgggtggtttaaatgattcgagaatcgttatccattacataatgttaacgtgactgctgagtctgtgagggctgacgtgaaggcagctgaagagtttttggaaactctagatgagtcgtggagaagaaatacttgccagagcaaatcttcaatatggaggaaacctccctattctggaaacagatgcctgaaaggactttctgtcataagggggccaagtcaatgccaggtttcaagggttttaaggacaggaaacggtcttgctttggggcaatgttgcaggctacaaattgaagccctttgtgatccgacacagtgaaaaccccagggccttcaagcatatcagtaagcacacgctgccagtgtactacaggagcaataaaaagtcatggatgatccatctcctcttccaagatgccctcctgaattgctatgccagagaaatggagaagtactgtttggggaataacatacctttcaagattttgcttattgttgataatgctcctgcacatcttccttttactggtgatcttcatcccaatttcaaagtggtgtttctctctccaaacaccacctctttgatccaatggatcaaggaattatagcagctttttaaaggcctactaccagagaagggccttcgcccaggttatcactgtaactgaggaagacactgatgcaattctggaaggattacaacagccaagactgcatcaagaaccttgcttgggattggggtgatgtcaccaaggagtgtatgaatggcatctggaagaagacactcaagaggtttgtccatgacttcaaaggatttgccaaggatgaggaggttgcaaaaatcaacaaggctgtggttgagatggcaaacaactttaacctgggtgtggatgaggatgacattgaggagctcctagaggtggttcctgaggaattgactaatgaggagttgttggaactggaacaggaatgcatagctgaagaagaggcaagagaaaaggaaactgcaggagaagaagaagaacccccaagaaaattcacagtaaagggtttagcagaagcttttgcagacctcaacaagctccttaaaaagtttgaaaacatggaccccaacaccgaaaggttttcattaatagagaggaatgttcatggtgcattatctgcttacaagcaaatctatgatgacaaaaagaaacaaaccaagcaaaccatcatggacatatatttctgaaaagagtgacacctcctcaagaagagcctcaggcaggtccttcaggagatattccagaagaargcatcgttatcataggagatgacagctccatgcatgttattgcccctgaagaccttccagtgggacaaaatgtggaggcggaagacagtgatattratgatcctgaccctgtgtaggcctaggctaatgtgtgtgtttgtgtcttagtttttaacaaaaatnttttaaaaaataaaaaaatwaaaaatttwwaaatagaaaaaagcttatagaataaggatataaagaaagaaaatatttttgtacagctgtacaatgtgtttgtgttttaagctaagtgttattacaaaagagtcaaaagttaaaaatgcaaaagtttataaagtaaaaaagttacagtaagctatggttaatttattgctgaaaaarwwwwwwwwwwwwwataaawttagtatagcctaagtgtacagtgtttataaagtctacagtagtgtacagtaatgtcctaggccttcacattcactcaccactcactcactgactcacccagagcaacttccagtcctgcaagctccattcatggtaagtgcyctatacaggtgtaccattttttatcttttataccgtatttttactgtaccttttctatgtttagatacacaaatacttaccattgtgttacaattgcctacagtattcagtacagtaacatgctgtacaggtttgtagcctaggagcaataggctataccayatagcctaggtgtgtagtaggctataccatctaggtttgtgtaagtacactctatgatgttcgcacaacgaaattgcctaatgacgcatttctcagaacgtatccccgtcgttaagcgacgcatgactg

SEQ ID NO: 14 - DNA, 335 bp, Homo sapiens
  repeat_region (1)..(335): golem_a
  ref <301>: AUTHORS: Jurka, J; Walichiewicz, J; Milosavljevic, A
  ref <302>: TITLE: Prototypic sequences for human repetitive DNA
  ref <303>: JOURNAL: Jurka, J; Walichiewicz, J; Milosavljevic, A
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements
  ref <309>: DATABASE ENTRY DATE: ____-__-__
  ref <309>: DATABASE ENTRY DATE: 1996-01-26
cagtcatgcgctgcataacgacgtttcggtcaacgatggaccacatatacgacggtggtcccataagattataataccgtatttttactgtaccttttctatgtttagatacacaaatacttaccattgtgttacaattgcctacagtattcagtacagtaacatgctgtacaggtttgtagcctaggagcaataggctataccayatagcctaggtgtgtagtaggctataccatctaggtttgtgtaagtacactctatgatgttcgcacaacgaaattgcctaatgacgcatttctcagaacgtatccccgtcgttaagcgacgcatgactg

SEQ ID NO: 15 - DNA, 1205 bp, Homo sapiens
  repeat_region (1)..(1205): golem_b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-10-26
cagtcatgcgctgcataacgacgtttcggtcaacgatggaccacatatacgacggtggtcccataagattataatggagctgaaaaattcctatcgcctagtgacgttgtagtgcaacatatyactcaktactcacgcgtttgtggcgatgctggtgtaaacaaacctactgcgctgccagttgtataaaagtatagcacatacaattatgtacagtacataatacttgatagtgataataaatgactatgttactggtttatgtatttactatactatactttttattattattttagagtrtactccttctacttattaaaaaaaaaagttaactgtaaaacagnctcaggcaggtccttcaggagatattccagaagaargcatcgttatcataggagatgacagctccatgcatgttattgcccctgaagaccttccagtgggacaaaatgtggaggcggaagacagtgatattratgatcctgaccctgtgtaggcctaggctaatgtgtgtgtttgtgtcttagtttttaacaaaaatnttttaaaaaataaaaaaatwaaaaatttwwaaatagaaaaaagcttatagaataaggatataaagaaagaaaatatttttgtacagctgtacaatgtgtttgtgttttaagctaagtgttattacaaaagagtcaaaagttaaaaatgcaaaagtttataaagtaaaaaagttacagtaagctatggttaatttattgctgaaaaarwwwwwwwwwwwwwataaawttagtatagcctaagtgtacagtgtttataaagtctacagtagtgtacagtaatgtcctaggccttcacattcactcaccactcactcactgactcacccagagcaacttccagtcctgcaagctccattcatggtaagtgcyctatacaggtgtaccattttttatcttttataccgtatttttactgtaccttttctatgtttagatacacaaatacttaccattgtgttacaattgcctacagtattcagtacagtaacatgctgtacaggtttgtagcctaggagcaataggctataccayatagcctaggtgtgtagtaggctataccatctaggtttgtgtaagtacactctatgatgttcgcacaacgaaattgcctaatgacgcatttctcagaacgtatccccgtcgttaagcgacgcatgactg

SEQ ID NO: 16 - DNA, 704 bp, Homo sapiens
  misc_feature: n is a, c, g or t
  repeat_region (1)..(704): gsat
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gaattctgggagccttccaaggagggctttctcatcccagacgcccccatatctgttccgggcaggctataaagcccaaggctttggagcagggtgcctgtttctctccaaantcgcatgactgcaggtcgactctagaggatccccggcggaaggcccgacaagagaaacccgggccgcaggtggcgttggcgggccgaaggtactcaggatgacgttaaggcaggaagaggagagccacggtgagatcgcagagaatggtcagagncctccctagaaggccctctcccattccagaagccccccaggactttcccaggcagtgctgtaaagccaccaagctttggagccaaggtgactgtgtctcttgaggaagggcccgccacaaccaaaaacgttgcccgcctgatggcgtgnctggcctgcagggactcagggggatgtggagncagncagaaaggagaancaacgagactgcaggaaatgctaggancctcccaagaaggactttcttatcccaggagtttcaagggctgtcctggtcggnctgtaaanccccaggccttggaacagggtgcctgtgtctctcattgaagnccccaacaagagaaaacggtgctgcagggtggcgtgcgctggccgcagggactcaggaggatgttgagggagacagaggggtgaagcgttgagacgactgggaattc

SEQ ID NO: 17 - DNA, 1205 bp, Homo sapiens
  repeat_region (1)..(1205): gsatx, where x is a, c, g or t
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gaattccggatccaagtctactcttcagccttgntgattttttccttgggntgcctcaacctccccctgaaagtctggtgtcctgtaactgttcccctagggatatcttcccactttggggtgccccccatgggagaaacacacacccttggtgaaagccagggactccacgacccccttgggcccggctctggaactgctggaaaggcactggtctctggtagagtacaccagcctcctattcggactcgccacttttttcctccagctgcctcaatgtcaccctgaaatcctggcatcgtgaccacgtccctcggggacttcttgtcatgttgggcgggccgcctgtggggacagacacacacaccctgtgtgaaagnccaggggactccacaacccctgcagggcccagganaggagctgctgggaaggtactggcctccagtggaagacttcagncctccatttcagcctcgccgcttttttcctcaggctgcttcaacgtacccctgaaagcctggnatcctgtttcagtcactcgggatacttattnccactttggggagctcccccgtaggagagacatgcaccctgcatgcgtggcctgagaaaaaagtggtgaggacaaagaggagaccaggatgccccaccagaagacagcgctttcccggcagcccctgcgcatgacccaggtgggtggtggagtccctgaccccactaggggtgtgtgcctctcccacagaaggcaccacaaagcagcaagaagtcccccagggaacagagaaaggcagccaggctttcagaggggaggtttgaggcaggcttgggacaaaatagggaaggccaaaagaggacgcctgggtnccttcgccagaggtcagtgccttcctggaagctcccgagcccgatctgggggagtcctgacgtccctggccctcatgcagggtgcgtgtctctgccacagaaggcaccttnatgccgcaagaagtccccaggggacagagacaggcggccagnctttcagggggaggatgaagtaggcctgggacaaaagcggcgaggccaaacgaggtcagggtgccccacaggaggtcagggccctcctaacaacccctgcgcccaaaccgggggtgtcgtggagtccctggctcccaccaggggcacgtgtctctcccaccgaggacaccccaaagctgcaagaattc

SEQ ID NO: 18 - DNA, 2463 bp, Homo sapiens
  repeat_region (1)..(2463): hall
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aagatggcagattgaacatatacatttatttttctccctcccaaaaccccactaaaatgacaataaaggaattttttaaaagacataaacccacaaggacaaagagaacaggagaggagacaatagcaacaaaattttggaagctggaaagcagatggataagtggtaactgacttagcagacctgagaaagctgaatcctaagccagcagtggggaaagccaagaagcaacccaatttacaccgccagaatcctccccaaaaggctcaggaattggtggcaccaggtacctctggaagtgggggtgaaggtgaggctaaaaacagggaggattgattgaaagtctgtttaagaagcagttagatccccagattccctcccccactctatngcagccagataactgatcctcctccaccctagcagaagactggaggtttattctctggagaggataaaacaaaggggtctctggactggggaacaccaggcacagttgagggcagaggggnactgtactgaaaacaggggaattaagtgaaagtttacatactgaatgttgagactcccagccctcttcccccattcagctcccagaatgctggcagccaggcctataccctccagacaggagattagaagagntcttctctggagaatctgaccagcccaagagaaaagacttaaaaatactgataatagaggttccccaaacaaaatagcccagccagatcacccctatagtgaagcccacmacctggcaagccccacccacgcactcagagcttccaagtcgctttttagtstcccactcttaaatatgagcagacagccaaggatcaccagacatctgaggaaancctctaatatggcagacaganaaataaaaacagagaaaaacawwntntatccatgaaacaagaayaggatgctataaaaaggaacattcagagaacaaaaagaagctcttggaaattaaaaacgtgagagcagaaattaaaatttcaatagaagggttggaagataaagttgaggaaatctcccagaaagtagaacaaacaaaggataaagatacggaaaataggagagaaaagaattaaaaaaattgaggatcagtccaggaggtccaacatccaactaatagaagttccagaaagagagaacagagaaaaagatggaagagaaattatcaaagaaataattcaagaaaatttcccagaactgaaggacatgaatttccagattgaaaggncccaccgagtgcttaccgcaaaaatgaaggaaaaaaatagacccacaccaaggcacatcattgtgaaatttcagaacactgaganaaaaggaaaatcccaaaagcttccagagagaaaaaaaggtcacatacaaaggatnagaatcagaatggcatyagacttctcaacagcaacactggaagctagaagacaatggagcaatgccttcaaaattctgagggaaaatgatttycaacctagaattctatacccagccaaactatcaatcaagtgtgagggtagaataaagacattttcagacatgcaagatctcaaaaaatttacctcccatgcaccctttctcaggaagctactggaggatgtgctccaccaaaacgagggagtaaaccaagaaagaggaagacatgggatccaggaaacaggggatccaacacaggagagaggtaaagggaattcccaggatgatggtgaagggaaattccaggatgacagctgtgcagcaggcctagagagcaaccagtccagattggagcaggaagatggaaggctccaggaggaatgttctcaagaaaatagaanacaaatgaaactgatagattatctgatgtgtttgaatatattgagaggntatnatttagwcatgtgaaagtttgggggagaattgaattagtgataggtacanagaaaactaagcaaatgaaaaaaagcaagacaattattaactccagggaaaacaaaaagttgtacaagaaaggaaatgtaatcatagtacactacatggctcagctgtgaataacatatttacatagtcataataatgtaaacactraatactgatttaaccaaaattatgatataaactatattgggaggataagaaatggaaagggtgtgcgtatkgtgtangnggaatgaragaantaaatcctcatcttccatagtaggaagtcartagataatgtctaaaactgaaaaatcaagaaatagcaatataagcatgttatttagaaatatggaggtaaatattccaaaagaatcagctaaaagagttgaaagtggttgcctctggggaaggagctgnaggtggtgaagagngnagggacggggaaytgctgttttttataagccttttagtactatttgaccttttaaactatatacatrtattactttaatttaaaaaantaanttataaaaaagnaaataagta

SEQ ID NO: 19 - DNA, 8735 bp, Homo sapiens
  repeat_region (1)..(8735): herv15i
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tttctggtggcccagatggggattggagacgacagatttactgtctcctttgcctgtgggactagagccccggggccgggggagacccggcatccaaggcgtgccacgggggagcttcacccggacggagaccggctctccccgcatcccggcggcctgcccggcagtgcaacggaaccggggatggggctgcaggacgataccagcacttcaggaaccgcggtaaggagcaagggcccaaggcaggaaagcccatcccatagggacgaaggggagcttgatcacctcccagggaccgaccactaatccaacccagagtggctgggggtggcaggagtggcctgccaatttggatgaacctcgtgtccccctaacaagtgaaagtggttcactggtggagaaaatgggccgatagagcggcaagtccagcaaggaagagcttgctggcagggtggcaagagtggcttgccaccccaactgggagtgtgtgggtgtgtgtggacctacccaggacatgagagaggctcgtttcgtccgatgaggagtcctggggtaggagtggtgtgtgtatgtgtgtgaatgtgggagcctaactaggctcacccgggacacgggagaggcctgtttcgtccgatgaggagtcctggggcaggraaggtgtgtgaaagagacggtctcgggagaggccaatgcggggagtaatgtggggaggcacagatcccttagcgcgggctgtgtgctccgaggcgagtgtgggggaaatcagacctaggacgttgcatatggctgataggaccagcttcacggccgcagcaggctgtgacaggggaaggcacattcctggctaagcagtgtccgaaactcccgtaataggacccggtctggtggacctgagagtgaaagtgagagggaaagtgcaccacaagggaggaaatgggaggaaaagcatcgaaaccaactcctttggagtgcatgataaagaattttaaaaaaggatttagaggtgattatgggatgaaactggatgctcaaaagttaaggacatactgtgaaatagattggcctgcttttaatgtggggtggccctctgaaggtacaatagacagggaattaattggccgtgtgtttaaggtggtcactggagttggaggacaaccaggatatccagaccagtttccctatatagactcttggctcagtgtggcacaaactcaccccaagtggctacagccctgcctagagggatattgcaaggcattagtggctcaggcagcccaaccaaaggaagcagaggaacctaaagcccctagagtctctcaggaaaaggaatccctgaagcctcagctgaaaccagttcttcaggctccacctgaggaaagggaatgtccgcccccatatatgtgccagtctacctgtctttggccagaataaggcaggaggcagagtcaggagcatccacagagtcaggctgagaggaaagtgaggcccagtctcccccaaccccagaggaacaaaagcctcccttagaaaaaaaccaggaagatggacagagcaaggcagctgggtgcctccgctcaggctgaccacaggctttgcagatgccacttcgagagaacaggacacaagtttatgatgaccaagggcagatacaaggaggctctaggctttatgtttatcagcctttctccactactgatctcttaaattggaaacagcacgcccccttgtatgcagaaaagcctcaggctgtcattgatttggtgaattctattattataacacaaaacccaacctggccagattgtcaactacttttgctaactttaatacagaggagcataggagagttaatcaggcagctctcagctggttagaaggggaagccccagaggccacccgtaacccatgccagttctccgtggagcgatacccaaatgaggaccctaactgggacccaaatgaggcaggggacatggaacagctgcattatatagaagggcactcctgaacaggataaaagcaggaggaaggaaggcattgaatatccataacatatcagaagtgggccaaaagcctgacgaaagccgcagtgcattctatgaaaggctttgtgaggcatagaggctgtacactccaattattccagaggctcctgaaaaccaaaatatgataaatatgacctttgtcaggcaagctcagggagacataatacgaaagcttcagaagttggaaggcttttcagggaaaaatattagtaaactcctggaaatagcaaacaaagtattaaaaaactgggaagaagaggcagagaaaaaggaagaaagaaaaacgagaaatagaaacaaagagacagctcaatttctgctgcactagcagaaagtaaccctggatttgctagagggcgtggccgaggcagaggccaaggaacagggcagacaagacccggagatgaaagccagtcccagttggacaggaatcaatgtgaaaggtgcaggcaaatgggccactggaaagatgagtgccccgaaaaggaaaaggatgatgatggtcagtggtctaacacccaagtgcggtgttaggttgctagcagtggtacttccaaggcagatcccgatctgatcggcttggcaggggccgagaatttagaggactcagacagaccaggctccatccttttaggccttgtggagcctatggtctctatggaagtagggggccgattaatgaatggattttttggtcaatactggtgctgatttctctgtggtaactcacccaattagccccccctcaaagaactgtgctactatcgtaggggctacagaggccaaagaaaagagacctttttgcaattccaggagatacgttattgggggacaagaagtgcagcatgagtttctatatatgccaaattgtccagtgcccttgttggggagagacttactccagaaactgcaggcacaaatttcctttacacctgaagggaatacgacaccggaatttggaaagtctaaggcaatggtattgattctaactgtcccagaggctgaggaatggcagctctctgaactgtgtgccagaaggataccggagctggacctacacagtatgtagggaatgcttttcaaggttccaggtgtatgggctgaggacaatcctcctggacttgctgtaaacagacacccagtggtaatagagcttaacactcatgctgccctggtatgagtctgtcaatacccactacccaaagaggtaattgaaggcataacacaacatctaaatcggctctatgaacaagggattatagtaaaatgcaagtcctcttggaatactcctctgcagcctgtgcacaagccaaatggtgaatacaggccagtgcaggacttctgggtggcaaacaaggccactgtcactatctatgccatagtacccaacccatacaccatgttaggacagattcctgctgaggccatgtggttcatgtgtctagacttaaaggatgttttctttgcttgagacttgctccccaaagtcagcctatatttgccttccagtgggggcaattgtaatatacctggacaagactgccacaaggatttaagaattctcccattatctttgaggacgctttggctaccaaccttgaagcttttgcaccatttagtgacaattctgtggtattacaatacattcatgatttgctattcgctgcccccaggagggaggaatatctccaaggaatagagaggcttcttcacctgctgtgtgaagctggttacaaagtgtccaaggacaaggcaaaagtctgttttctggaggttggatatctaggattcatggtatcccaaagcctgcacaggcttggaagtgcatgcaaggaggctttatgtgcattgcccacctcagttacaaggcagcaggtcagggaatttctgggtgcagtgggattgtgccgaatctggattccaaacttctcccttatagcaaggcccttatttgaggctagcaaaggaaaggaaagagagcccctcctatgggaaaaagaacaggaaaaggccttcaaggatataaaggaagctctcatccaggccccagcactagggttgccagatgttaaaaaacccttctttttgtatgtggatgaatgaaagggaatggtatttggagtcttaactcagttgttaggctcttggcatcagccagtagcatacttttatccaagagactggacttggtggccttaggttggccccattgcctcagggcactggcagctaccgcgatccttatagaagatgccaacaagctagccctaggtcagaagataatattccgggtgccacacactgtagtcaccttaatggagcaaagaggacgtcgttggctgtcccactctagaatgctaaagtatcaagggcttctgtgtgagaatctgcgggtaacactacagactaaataccttgaacccagctaccctgctgcctgtggaggaacccgattggaagcatggtgggttgcctcaatgctggcaggaccttccccactgttgcataaatatggtggatgaagtgttcttgagctgggaagatctcagagatacccccttggagagcccagatgttgaatacttcactgatggtagcagtttcataacagatggggtgtgatatgcagggtatgcagtagtaacacaacactcagtagttgaggctcaagccttaccttctgggacttccgctcagaaggctgaattaatagcattaaccagagcactgttattggccaagaggaagaaagtaaatatatatactgactcaagatatgcttttgcaaccctgcatgcccatggggcaatataaaaagagagaggactattgactactgaaggaaaagatataaaaaataaagaagaaattttgcaattattagaagacatatgggctccagagaaggtggctgtcattcattgcaaagggcaccaaatcaggaaaagctatgaggcacagggcaacagaaaggcagaccaagaggctcagcaggcagcaatgagcaaggttttacctgaagaaagaactccagcaatgcctctccttatagagccccctttactggaggtacccaattactcttcaagtgaaaaagcttgttttcatcaggaaacaggaaacatatattaaagatggttggtggctgttctctgacgggaggctagccatcccagaaacaatagccccaaggtttgtgaagcagatccatcaaggaacacacattggaaggacggccctagagactttgataggtcagcatttctatgtgccatggctgtctgccatcacccatgctgtttgtgaacaatgtctatcctgtgtccggaataatccaaaacaaggacctactcgacccccaggaatacaggaaatgggagctgtgccttgtgagaacctgcttgtagactttaccgagttacctcgagcaggaggttaccggtatatgctagtgtttgtttgcaccttctcggggtgggttgaggccttccccaccaggactgaaaaggcacgagaggtgacaaaggtgctactaaaagacatcataccaagatttgggttgcctttaaccctaggatcagacaatggtcctgcatttgtggcagaagtagtacaacagttgactcaacttttaaagatcaaatggaaactgcacacagcctactgaccacagagttcagggaaggcgraacggatgaaccagacactcaaacagctactaaaaaagttttgccaggaaactcacttacaatgggatcaggtcttgcccatggtcctcctccaggtcaggtgtacacctacaaaacaaactgggtatttgtcctatgaaatattgttcggaaggccacccccaatcattaatcaaattagaggggatttaaaggagttaggagagttaacccttaagagacagatgcaggctttaggagtggcaatgcaggaggtgcaaagctrggtaagagaaaggatacctataagtctaacagacccagtgcatccacataagccgggggactctgtctgggttaaaaggtggaatccaacaaccttgggacccttatgggatgggccccatattgtaatcatgtctactcccactgctcttaaagttgcaggtgtcacaccttggattcaccatagctggctgaaaccagcggcagcagtgactcccgatgacgaccagtggattagccaacaagacccagatcgccccacctgaatagtcctacggcgaaacccaaccaccggtaagaaggacaactgccctgctccgaccacaccggaggctggtcagtctacgcatggctgaagcttgaagatcctgcaagctctgctctagtcacatcccggaagctgactagtcaatgcacagccgaagctaagaggaccatctctggataagtaaatgtggatacaattcataaccctagttataattctgttaatactgattgttctgttgttacgttaccactgcaaatgctgcaaatgtctatgcccagagggaggtttgccatgcccatgtgtagtgtaagcatgtttctattacatacactgatgttgttaccatttctgcctatactaaaaggggaggaatctctagaaagatgcccacactgtgtacatactacctgggtaaggaataccatagttaaaactctactgtaccatacctacagtacaggaaccaagttaggaacctgcgcatacaaccagaccacctcttcagtctgtgacccaggaaataatcagctacatgcatgttatgaccctaagcgcttaccctatgaattctggtttgaggtacatattaaatcagagggagaaaaagaaggagagcttatagctcgaaccaaagaagcccctccctcctataaaaggcctatttccttgtactttgatgcctgccatgccgcatatgttcataatcctaaaaaaccaaaagcagtctgcaatggtttaacacaagagaggcttagcaggagcagccctaaacatctgtactgagaaccacaaattggatgcccagactgtaacattcagtggtctatgctaacacagctccaacacttatattcaggaaggactgctctgctaagtagtatgtcagccaaaccaaattgtaagacaaggacatgcaatcctttaaattttactatcttaaagccagagctacctttctggtctacaggacagacagcactattacgagttgatagacaaggagcaggccttggagttccactactaattgtcaaaaagactagaaggactcaaatgtgtccaaccctgcaattctgggtccataagtcattctgtaagcattttgatcagtcagtgcctgagcttcccctatcaaccaaaaacttatttgctcaactagctgaaaacatagctggcagcttaggaatttcctcatgctatgtacgtggaggaactaatatggggaaccagtggccatgggaggcaaaggaattaatgccacaagataacttcacttcgcctaaccctgccagtgaaccaacagcctcagccagtgtttggttgttaaaaacctccataattggaaagtactgtatcgcccgttggggaaaggctttcacagaggcagtaggagaaacaacctgcctagggcaacagtattatgatgagactaaaaacaaaactctatggagaaacacccagaattactcctacttaccagatccaaatcctttctcttgattctctaccctaagccacacttggcatcagctagaggttccaaatgcttggaaagcaccctctggcctatattgggtctgtggagcatgggcatatcggcaactgctggctaaatggacaggggcatgtgtgttagaaacaatcaagccatccctctttttaattcctctaaagcaaggggaactcttagggtatccagtttatgatgaaaataaaagaactagaaaaagcataatcacaaaaatagacacaaatgtcaaaaaggatgcagacataggagactggaaggataatgaatggcctcctgaaagaatcattaaatagtatgggcccgctatctgagcgcaagttgggtcatgggaataccgcaccccaatctatatgctcaaccgcatcataaggttgcaggcagtccttgaaataataaccaatgaaatgtcaaggaaactagatttattgataacacaagcaacacaaatgagaaatgctacatatcagaatagattggctttagattacctcttagcctcagaaggaggagtatgtggaaaatttaatttaaccagttgttgcctagaaatggatgataatggccaagctctaatggaaaccacagctagaatgtccaagttggcccatgttccagttcagacttggtctggatggtccctggattccttgtttggaggatggttctcaatgtttgggggattcaaaaccctcattggtgggtttttgtttattcttggcatctgcctcatcctcccttgccttttacccctgtatattaggagtatttgtcaactatagaggcagtagtaacccgaaacactaccatgctattgacggcattaaccaaatatcagccactgccaataaaagaaacagctcagctccgggaagagatggcaaatagtggtgctttctattaacatctttgttttaaaaagcaccaaaggggggaaa

SEQ ID NO: 20 - DNA, 4996 bp, Homo sapiens
  repeat_region (1)..(3596): herv16
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gttggtaccaggagtggtccgagaaagcagacgmtgctaagatgkgattttggagttggatcacccgctgncwagctggcaatgaggactccatcacwngtggtaggtggagcatagatagcctctggcacaaggtagtagtgsaattgttaaaactttcactggtggtgaactgggatggcgtactggtgaaaagagaacgcactagctggtgcaatgcttcaggcgtttgagaaatatgggatgaattanntacatggaaggacartggaattggatggctgtcgctaagcttgactgacactctgkaaaagaacaataaaragctgagagcgattaattggcaattgaaaactaagcatgaaagccagagggcctctttggtagcatataaagaggctctcatctcctgcagcggganggcagagaaasctgaggatcagacccagaatttgatcaaagtagcaaagcttcaaagaaggttaaattcccaaccaaggcaggtcttctatgccnagktcagcgccccggttaggsaagaacgggaccctgacacacggratggggacgtctggattgatgcccctaaaaatcttgaatccccagattcccctgaaccctttgagcctgcagaagtgacctactcctccctattaagggctrgcattcgcttcttnctttatgggaagacagtacggaggcctctcccttngcaagacaacatgggttttccycaggatctgcctccacctcatctcctggccactaggccaataactagggttaartcacarcgtaacctggccggggangtgctgggcctgataaggaaagaaagggactataccccaaaggagttgcgggacatatctagccagcatatactagcaggaccgggagagtacsyacgggactggattctgaggacgcttgatcaagggggccggaacataaakttggataagggagagtttattgatttgggagcactctcccgggatacaggatttaacaccctggcgaggaccccaggagatggcgcaaacacactgctaggatggctcctagaagcatggagaaagcgatggctcacactaagtgaggtagaaatgccagaattgccatggcagatggtgaaaaaagggatcaaaaagctcagggaggtgggcatgctggaatggatatattatgtraggccagaagacccgccagaggattatgttstacaggaggactcaggggacgcacnatttaccaaagccataaggaatgtgctggwgagaggggcgccagcatcaccgagaagttcaatggtggctctcytctgcaggccagggttgataataggagaggcaatcacagagctgggctcgctgatagcagtcggggtgatagggctctgacgtaatagaggccaggtggtngcactcggccgtcagaagcaaggtggacgtaaataccacaatgcactgcagggtcggagtggcagtcggganggcctgacttgcggggagctatgganatggttaatagaacacagtgtccctagaggcgaaatagacggnnagccaacaggaagacatggacagtcaatgggacatggtgtcctatgggcaagagagatgggctgccaacaagggtgtattgttcaactgaagcaagcgaaagaaacgaagggtgtannactaggaggctgagggcggtcgccccaataaaaagtcatratcccttgcccagtttccagatctgagccagttttcagacctagaacccattgactgaaggagaggccgggtccccaggaggaaggaccccgcaacaccacggcaagtgtacatcgtaatnatttctccagtccttccccaargggacctgtrgccatttactctgggtaactatgcaccggggaaagagaaatacccggacatttcgaggactattggacactggntctgagttgacattgatacccggagacctaaagtgtcatcatggtcctcccgttagaatgggggywtatgggggycaggtaataaatggaatcctggcccaagtctggctcacagtgggtccactgagttcacagacccacagtggttatntctctnatccctgantgtataattgggatatacatacttggtagttggcacaacccctacattggktccttggcctgcggggtgagagctatcatagtggagaaggccaagtggaagcttccgaaactgccctcaccttctccgggcaagacagtaaatcaaaaacaatatngcatcctcggggtggagaatggcagaaattattgccaccwttaaagacctaaaggatgcaagaggtgtggtctccatcatatcttcgtttaattcgccagtgcaaacccctgcaaaanctagacggatcctggatgacggtagcgggctaccacaaactcagccaagtagtatcccaattgcaantgctataccagacgtggtatcttcgctacagcagattaacatggcctcaagtatgtggtktgtagctattgatktggtaaatgtattcttttccatctctgtcanaaanaacnatcagaagcagtttgcattcactcggaacggacaacagtatacatatacagttttncctcagggcactactaactntcatgncctctgtcataatatagtctgaaggggtctgaaccacttggacatcctacagaacatcacattggtccactatgttgatgacatcatgctaattggaccggaataagcaggaagtggctagtacattggaggccttngtaagrcacatgcgctcnaganngtggaagataaaccctacgaaaatccgggagcttgccacatcaatgaartttttaggggtccagtggtctgkggcatgccggaatatccccccaaagtaaaggacgaattantntntcttgtaccttccaccacgaagaaggaagcgcaatgcctggtaggcctcttngggttntggananancatattncacacttgggaatantgttccgacccatatactgggtgacgcgaaaagctgccagctttgagtggggcccnagcaggaaagggctctntggcnnnnnnnnnnnnnnnnnnnnnnnnnnnnnnnnnncctctaagtcataaagtaagatgaatccagcagtagcccataatacggtggaaacagaatatcctagattaagtccgaggaaaaccagaggacacaggttaggtatatgagcagatagcccagatccccatgctatccaccacagttgcaccagtgcctctcctttggtttgaacctatagccatattaaagtatgtggtcccatataaccagttgaaggaaagctcaagcttggtttacaggatcagcttggtatgtgaacgtaagtcaaaatacgtggtgactgtattacagccccatttagaggtggtcctgaaaggcagcagggagtgaaaatattttcccagtgggtagaactgcaagcagtgcacctgattatccactttttgtggaaaaagaagtggtccaagatggtaatatatatgcattattggacagtagccaaaggtctggtgagctggtcaggagcttggaaggaaaagatcagagaaagggaagtctagagtagaggcatgtggatagacatattggaagtgatatgaaataggaagatttttgtatcaatcctattttaatgttcacatgaaagcatcaattgtgaaagagtaactgaagaactaagtagacaaagcgactttgaccactgacattaaccagcattcattctggccttctcaggactggtccaatagacatctcaaagaactagccatggcagaagaaatggaggtaatatatgggcccaatatcacagactcctgtgtaccaagacaatttagctgcttccctgtatgaatatccaacctgcagcaacagcgaccaaggctctatctcaaatacgacactatttatgaagaccacttagcagtgaattgactatattgtatgctttttatcctggaacagtcagtggttcatgctcacagaactatgtacctattctgggtatggatttgccttttctgcctgcacagcctcattaagcatctgagggatttgggggttcttgagccatagtctcggaatcccacacaacagagcatctggacagggtagtcacttcatagtaaagaaggggcacaaatgggtccagaacaagaggatccacttatcatatcaaatactgcaccatccagaaggagctgacctcacagaacacttctgaaggcaaagataaagcaccaataaaagtaaaccctgaaaaaattgggtgccgttctccaggatgcagtgtatacattaaatcacagacctatacgttaggctttagatctaattggaagaatgggattaggaataagaggtgaaagcaggagtgtgcctactccccatcgtagtggcccacaaggatcacagcagtggtttgaacacggattggactactgatatccaggaatcgccgcacaagaaggggaatccacatgtggcaggagtaattgactatgatgtgtaggaggggtagggctgctttagtaaaatgagtaagaaaggaatacatatgaaaccaggtgatctacttgagtgcctcctggtattctcttgcttcatttaactgtgaatggataatgtcattgaaaagagtttggacacctccacaatgaaagtttggttcacatggctaagtaagcttccaagacttgtcaaaataataactgtgtgagggacatttcaaataggtagtggaaaaggaagataataattaccagttctggcccagaaactaaatgcagcaaggggggctgtagtgtgtcccactatcctccctcttcaaagtttggcttcataaagagaagcttaaaggaataaggaaggaactgttccatgaacctgaatggagaaatagatctgtcgagtacaaaggtggac

SEQ ID NO: 21 - DNA, 8523 bp, Homo sapiens
  repeat_region (1)..(8523): herv17
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttttggcaaccacgaacggacatccaaagtggtgagtaatattggaccactttcacttgctattctgtcctatccttccttagaattggaggaaaataccgggcacttgtcggccagttaaaaacgattagtgtggccaccggacttaagactcaggtgtgaggctatctggggaagggctttctaacaacccccaacccttctgggttggggacttggtttgcctcaagccagcttccactttcagttttcttggggaagccgagggccgactagaggcagaaagctgtcgtcctgaactcccggcagtagccggttgagatcatggtgtagccagaagtctcaacagtcgcccatgcatgcacccctatctttccttctgacccatacctcctgggtcccaaccacaactttcttcaaagtgtagccccaaaattctccttacctctgaatatacttcctctgatccctgcctcctaggtactattggttcagacttccatttcctctagcaagttgtatctccaaagggatctaaggaagctctgcgctgcgtccttaggcacctaggctataacccagggagtcttatccctggtgtccctcccaatttaggcatacagctcttgacatgggcagttatgtaggacccactccccaccacccttgccagggccccaagtttgtaaatggctgagggaaaagagagacagaggagagagagagaaatggaggagaaagagagagagacagagaggagagagagacagtgagagagacagaagagagagagagacaaagaggagagagagagagtcaaagagagaaagaaagagaaagaaatagtaaaaaacagtgtgccctattcctttaaaagccagggtaaatttaaaacctgtacttgataattgaaggtcttctctgtgaccctatagcactccaatccactttgtggtcagtgtaaataagagcataggccgaaagcactgaggccattgacaacccgtagcttccctatcaaaaatccttaacccagtaacccgcagatggaccaaatgcattcagtcggtagcgcaactgctttgctaaaagtagaaaagtaacttttagaggaaacctcattgtgagcacacctcacctgttcagaattattctaataaaaaaagcaaaaaggtagcttactaactcaaaaatcttaaagtatggggctattctgttagaaaaaggtaatgtaactccaaccactgataattcccttaacccagcagatttcctaacgggatttaaatcttaattaccatacaaaggtccgaccagacctaggcggaactcccttcaggacaggacgatagatggttcctcccaggtgattgaggaaaaaaaccacaatgggtattcagtaattgatacggggactcttgtggaagcagagttagaaaaattgcctaataactggtctcctcaaacgtgtgagctgtttgcactcagccaagccttaaagtacttacagaatcaaaagactatctcaatcctgattcaaaaggttagctacaccctctctgtaatgcatttgcataagaacttgtttatgggaatgcatcttgatggggcagctgggttgttataaaataggaacccagcccagctctagaactcacccctgagcacaaaggcaatgttgggcacgctggtaaaggaccactagaatccagcagcctggacccctttctttgtggtcaagagaggcaggaaaacaggtgcaggactgcaacatcagtgagcataactaattcgataagcagaggtccatgggtggtgatgcaccctggaaagaataagcattaggaccatagaggacactccaggactaaagctcatcggaaaatgactagggttgctggcatccctatgttcttttttcagatgggaaacgttccccgcaagacaaaaacgcccctaagacgtattctggagaattgggaccaatttgaccctcagacactaagaaagaaacgacttatattcttctgcagtgccgcctggcactcctgagggaagtataaattataacaccatcttacagctagacctcttttgtagaaaaggcaaatggagtgaagtgccataagtacaaactttcttttcattaagagacaactcacaattatgtaaaaagtgtgatttatgccctacaggaagccttcagagtctacctccctatcccagcatccccgactccttccccaactaataaggaccccccttcaacccaaatggtccaaaaggagatagacaaaagggtaaacagtgaaccaaagagtgccaatattccccaattatgacccctccaagcagtgggaggaagagaattcggcccagccagagtgcatgtgcctttttctctcccagacttaaagcaaataaaaacagacttaggtaaattctcagataaccctgatggctatattgatgttttacaagggttaggacaattctttgatctgacatggagagatataatgtcactgctaaatcagacactaaccccaaatgagagaagtgccaccataactgcagcctgagagtttggcgatctctggtatctcagtcaggtcaatgataggatgacaacagaggaaagagaatgattccccacaggccagcaggcagttcccagtctagaccctcattgggacacagaatcagaacatggagattggtgctgcagacatttgctaacttgtgtgctagaaggactaaggaaaactaggaagaagtctatgaattactcaatgatgtccaccataacacagggaagggaagaaaatcctactgcctttctggagagactaagggaggcattgaggaagcgtgcctctctgtcacctgactcttctgaaggccaactaatcttaaagcgtaagtttatcactcagtcagctgcagacattagaaaaaaacttcaaaagtctgccgtaggcccggagcaaaacttagaaaccctattgaacttggcaacctcggttttttataatagagatcaggaggagcaggcggaacaggacaaacgggattaaaaaaaaggccaccgctttagtcatgaccctcaggcaagtggactttggaggctctggaaaagggaaaagctgggcaaattgaatgcctaatagggcttgcttccagtgcggtctacaaggacactttaaaaaagattgtccaagtagaagtaagccgccccctcgtccatgccccttatttcaagggaatcactggaaggcccactgccccaggggacaaaggtcctctgagtcagaagccactaaccagatgatccagcagcaggactgagggtgcctggggcaagcgccatcccatgccatcaccctcacagagccctgggtatgcttgaccattgagggccaggaggttgtctcctggacactggtgcggtcttcttagtcttactcttctgtcccggacaactgtcctccagatctgtcactatctgagggggtcctaagacgggcagtcactagatacttctcccagccactaagttatgactggggagctttattcttttcacatgcttttctaattatgcttgaaagccccactaccttgttagggagagacattctagcaaaagcaggggccattatacacctgaacataggagaaggaacacccgtttgttgtcccctgcttgaggaaggaattaatcctgaagtctgggcaacagaaggacaatatggacgagcaaagaatgcccgtcctgttcaagttaaactaaaggattccacctcctttccctaccaaaggcagtaccccctcagacccaaggcccaacaaggactccaaaagattgttaaggacctaaaagcccaaggcctagtaaaaccatgcagtaacccctgcagtactccaattttaggagtacagaaacccaacagacagtggaggttagtgcaagatctcaggattatcaatgaggctgttgttcctctatagccagctgtacctagcccttatactctgctttcccaaataccagaggaagcagagtggtttacagtcctggaccttcaggatgccttcttctgcatccctgtacatcctgactctcaattcttgtttgcctttgaagatacttcaaacccaacatctcaactcacctggactattttaccccaagggttcagggatagtccccatctatttggccaggcattagcccaagacttgagccaatcctcatacctggacacttgtccttcggtaggtggatgatttacttttggccgcccattcagaaaccttgtgccatcaagccacccaagcgctcttcaatttcctcgctacctgtggctacatggtttccaaaccaaaggctcaactctgctcacagcaggttacttagggctaaaattatccaaaggcaccagggccctcagtgaggaacacatccagcctatactggcttatcctcatcccaaaaccctaaagcaactaaggggattccttggcgtaataggtttctgccgaaaatggattcccaggtatggcgaaatagccaggtcattaaatacactaattaaggaaactcagaaagccaatacccatttagtaagatggacaactgaagtagaagtggctttccaggccctaacccaagccccagtgttaagtttgccaacagggcaagacttttcttcatatgtcacagaaaaaacaggaatagctctaggagtccttacacagatccgagggatgagcttgcaacctgtggcatacctgactaaggaaattgatgtagtggcaaagggttgacctcattgtttacgggtagtggtggcagtagcagtcttagtatctgaagcagttaaaataatacagggaagagatcttactgtgtggacatctcatgatgtgaatggcatactcactgctaaaggagacttgtggctgtcagacaactgtttacttaaatgtcaggctctattacttgaagggccagtgctgcgactgtgcacttgtgcaactcttaacccagccacatttcttccagacaatgaagaaaagataaaacataactgtcaacaagtaatttctcaaacctatgccactcgaggggaccttttagaggttcctttgactgatcccgacctcaacttgtatactgatggaagttcctttgtagaaaaaggacttcgaaaagtggggtatgcagtggtcagtgataatggaatacttgaaagtaatcccctcactccaggaactagtgctcagctagcagaactaatagccctcacttgggcactagaattaggagaagaaaaaagggcaaatatatatacagactctaaatatgcttacctagtcctccatgcccatgcagcaatatggaaagaaagggaattcctaacttctgagagaacacctatcaaacatcaggaagccattaggaaattattattggctgtacagaaacctaaagaggtggcagtcttacactgccggggtcatcagaaaggaaaggaaagggaaatagaagagaactgccaagcagatattgaagccaaaagagctgcaaggcaggaccctccattagaaatgcttataaaacaacccctagtatagggtaatcccctccgggaaaccaagccccagtactcagcaggagaaacagaatggggaacctcacgaggacagttttctcccctcgggacggctagccactgaagaagggaaaatacttttgcctgcaactatccaatggaaattacttaaaacccttcatcaaacctttcacttaggcatcgatagcacccatcagatggccaaatcattatttactggaccaggccttttcaaaactatcaagcagatagtcagggcctgtgaagtgtgccagagaaataatcccctgccttatcgccaagctccttcaggagaacaaagaacaggccattaccctggagaagactggcaactgattttacccacaagcccaaacctcagggatttcagtatctactagtctgggtagatactttcacgggttgggcagaggccttcccctgtaggacagaaaaggcccaagaggtaataaaggcactagttcatgaaataattcccagattcggacttccccgaggcttacagagtgacaatagccctgctttccaggccacagtaacccagggagtatcccaggcgttaggtatacgatatcacttacactgcgcctgaaggccacagtcctcagggaaggtcgagaaaatgaatgaaacactcaaaggacatctaaaaaagcaaacccaggaaacccacctcacatggcctgctctgttgcctatagccttaaaaagaatctgcaactttccccaaaaagcaggacttagcccatacgaaatgctgtatggaaggcccttcataaccaatgaccttgtgcttgacccaagacagccaacttagttgcagacatcacctccttagccaaatatcaacaagttcttaaaacattacaaggaacctatccctgagaagagggaaaagaactattccacccttgtgacatggtattagtcaagtcccttccctctaattccccatccctagatacatcctgggaaggaccctacccagtcattttatctaccccaactgcggttaaagtggctggagtggagtcttggatacatcacacttgagtcaaatcctggatactgccaaaggaacctgaaaatccaggagacaacgctagctattcctgtgaacctctagaggatttgcgcctgctcttcaaacaacaaccaggaggaaagtaactaaaatcataaatccccatggccctcccttatcatatttttctctttactgttcttttaccctctttcactctcactgcaccccctccatgccgctgtatgaccagtagctccccttaccaagagtttctatggagaatgcagcgtcccggaaatattgatgccccatcgtataggagtctttctaagggaacccccaccttcactgcccacacccatatgccccgcaactgctatcactctgccactctttgcatgcatgcaaatactcattattggacaggaaaaatgattaatcctagttgtcctggaggacttggagtcactgtctgttggacttacttcacccaaactggtatgtctgatgggggtggagttcaagatcaggcaagagaaaaacatgtaaaagaagtaatctcccaactcacccgggtacatggcacctctagcccctacaaaggactagatctctcaaaactacatgaaaccctccgtacccatactcgcctggtaagcctatttaataccaccctcactgggctccatgaggtctcggcccaaaaccctactaactgttggatatgcctccccctgaacttcaggccatatgtttcaatccctgtacctgaacaatggaacaacttcagcacagaaataaacaccacttccgttttagtaggacctcttgtttccaatctggaaataacccatacctcaaacctcacctgtgtaaaatttagcaatactacatacacaaccaactcccaatgcatcaggtgggtaactcctcccacacaaatagtctgcctaccctcaggaatattttttgtctgtggtacctcagcctatcgttgtttgaatggctcttcagaatctatgtgcttcctctcattcttagtgccccctatgaccatctacactgaacaagatttatacagttatgtcatatctaagccccgcaacaaaagagtacccattcttccttttgttataggagcaggagtgctaggtgcactaggtactggcattggcggtatcacaacctctactcagttctactacaaactatctcaagaactaaatggggacatggaacgggtcgccgactccctggtcaccttgcaagatcaacttaactccctagcagcagtagtccttcaaaatcgaagagctttagacttgctaaccgctgaaagagggggaacctgtttatttttaggggaagaatgctgttattatgttaatcaatccggaatcgtcactgagaaagttaaagaaattcgagatcgaatacaacgtagagcagaggagcttcgaaacactggaccctggggcctcctcagccaatggatgccctggattctccccttcttaggacctctagcagctataatattgctactcctctttggaccctgtatctttaacctccttgttaactttgtctcttccagaatcgaagctgtaaaactacaaatggagcccaagatgcagtccaagactaagatctaccgcagacccctggaccggcctgctagcccacgatctgatgttaatgacatcaaaggcacccctcctgaggaaatctcagctgcacaacctctactacgccccaattcagcaggaagcagttagagcggtcgtcggccaacctccccaacagcacttaggttttcctgttgagatgggggac

SEQ ID NO: 22 - DNA, 6053 bp, Homo sapiens
  repeat_region (1)..(6053): herv18
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
atagtcagcaggatcccgaggtgagtgagccttcggcccccgatgatcccgggtcggccatgtggccgcagcatgggttgtggtacccggtggcagctgtgctgctaggatgggctccagtggaaacatgggcggcggtggacgggtcccccatgagcgtggagaaggcgctgaagcacctggaagcgcagagcaccgagaaggagcgtgcctttgccggcagagtcggatgggcatttttgactgtgctacaggaagtacatgctcagtccctgcgggatgcagcacaggtaagggacctccaggcgcaagcggagcgcctggaggcccagatacacagcttggaaaaagacctggrggtaagggacctccaggcgcaggcagggcgcttggaggcccagctacacagcttggaaaaggaattagaggctgccgtgaatgcaggcctgggcccgtcatcccggccagagacccccactcggtctgataccgaggaggaagaacccccgttgcgggctcacccagtggtccgtcagaaagtagagcatgaacagccgttggggccccaagggcgggctcagggaccccctaccatgatggaacacacttcatatagtgcctataccccaactgagttgcgggaattaggcaagcagtgtcggcagcgttcgggggaacccctacccgcctggatgcttcacctttgggacgagggagctgacagtattttctgctccacctctgagatggaaaagctggcctccattatgactcacccctccctccgtcagtggttgcaggtgagcaggcagttagcacaggggcaaggcgaccacaccctaattgagtggctgatggcagccatacgaacggtatggaacgatgctggagaaataccagaaactgtgagtaaatggcagtcatatacagatttggtgcaagtaattcaggagatgggtatgcggcaggctatgtttgatctgaatacccgagggccagatgatgaacgctttacctcccacatgagggatcttgtgttgggctctgcgcccccgagtgccttcggctccctggccgctgtcctcaccccgtatgtggggcaccacatacatgaggtgactactgccatggcggccctcagggaagcagaaggccatcggcaggaccggggagtccgcgccataaagaaggggaaggcgccccctccacagggggccaccccatgagacaaaaaggggccccaacgggtgactcgcacgcagatgtggattgatttgattttggctggggttgaccgagagaaaattgataagcagcccaatgaagtactgttaactttgtggaggcaattgtccccagagcagcaattccagaaaatgcccaagagggggaaggacattgctgctcgacccagtcccgcccagacgctccagctcaaggactacttgctgcagccaggcggaggtatagagccttttctgtttgattagggaactggccgaggtgcccggcttggggggacaccggacgaccggaggccacatgtggaattggcaatccactggtcccccaccaatgtacagtgggtgctggcgctggtagataccggcgcagattgcagccttgtctatgggaacccggataagtttccgggcaaggctgcatatattgacggctatggaggccggtcagtgaaagtgaaacctgtatctttgcaccttggcatcggccgcttggctccccgcttatacactgtgtatgtctctcccatacctgaatacattctgggggtggatgttttacatggcttggctttacaaaccatggccggagaattcagactccaagtacgtgtggttaagccggtactgcgtggacatacgcatcaccagccccaggtcctgccacaaccccgacgggttacttccactcatcaataccgcttgccaggtgggcatacggagataactgagactattaagaagttaaaggaggtgcagatagtgcgtggcacccatagcccctacaattttctggtatggccagtcagaaagcctgatggaacttggcgaatgacggtggattatcgagaactaaataaagtaacaccccctttacatgcagctgtaccatctatcatggatttgatggaccgcttgacaacggaattgggacagtaccactatgtggtggacttggccaatgcattcttctcaattgacattgctccagagagccaggaacagtttgccttcacatgggaagggcgacaatggactttcacagtgttgccgcagggctatatgcatagccccaccatatgtcatggtcttgttgccacggatttagccgcctggaaatgtccaaagggggtccacctattccattatattgatgatattatgttaacctctgattctcttgcagatttagaagcggcggcacccctcttgcgacaacatttggcagcatgcggttgggccgtcaacgaatccaaggtccaagggcctggattgtctgccaaattcttgggagttatctggtcgggtaagacgaaggccataccagaggccatcattgataaaattcaggcatatccccggcccaccatggtgaggcagctgcagacttttgtgggcctcttgggatattggcgggcattcgtgccccatttggctcaaatgataaaaccattgtatcagttaacaaaaaagggagctgcctgggattgggatgatgaggctgagaccgcctttctggcagccaagcgggctattcagcaggcacaagccctacgggtagttgaccaggggcgcccatttgaactggatgtgcatgtgaccacagatggttttggctggggcctatggcagcgcacggagcgcttgagaacgccagtaggcttttggtcccaactttggaagggagctgagctccggtattcattgatagagaagcagttagcagctgcatatgctgcccttcaggctcgtgagagcgtggcaggatgggctacagtcatcgtgcggatgacttacccaatagcgggatgggtacgttcatgggtaacgaccccccagactgggacggcgcagacatccactttagcaaagtggggcgcctacttagaacagcggagtacgctgagtacaagtcccttagcagcagagttgcaagaggtcttgggacctgtagtcctaatgcaagataaggccatggggcctgaggcacccctagaccctgagccttcaccgtttaaggaagggcatccccccattcctgatggggcatggtacacagatgggtctagccggggtgctactgctgcctggactgctgtcgcagtccagcctagtactgacaccatatggtttgataccgggtgtggacaaagtagccaatgggctgaactcagggcagtgtggatggtgatcaccaaggaggtgacacctatggtaatctgcaccgatagctgggcagtttatcgaggcttaaccttgtggttaactacctagaagttacagaagtggctagttggtcaccggcccatttggggccaagccatgtggcaagacctatgggaaatgggtcatcaaaaagatgtaactatttatcatgtgtcaggccatatgcctttggccgcccccagcaatgatgaggcagatgccttggccaaggtccaatggttagagtcggcatctacatgagatgtggccttgtggctacaccggaaactgggacatgcggggggtaaactgatgcaacaggtcaataagtgctggggtctgtctttgcccacgcaagacatttgggaggcctgccagaagtgcccagcatgcgctcaggcataccctagacggagacagctgcccagtgttacacaacaagtgacggtagggcggatgcccttgaccagatggcaaatagactacattgggccgctgccaaagtcgcaggggtatacacatgcactgacggctgtagacatggccaccagcctgttgttcgcctacccttgcagggtggccgaccaacaacacaccattcaggccctgcaacacttatgtgccctatatggtcgtcccctggccattgaaagtgataggggaacacatttcactggacagcaggtacaacagtgggcacaacagatggacataaagtgggggtttcatgttccttacaactcgcaagccgcgggtatgattgagtgatataacggactcctgaagaatgggttacacttgcatgttactcccccgtctttgcggggctggagttccaggctggacctggtgctccaaatcttgaatgaatggccacggaaaggcggcccagccccagtggaggcactgttacaccgggccgccgcccctatccagttacagatacacaccaaggatgacctcctccgaccaggtatggggacaaacggtaacctgttgttgcctgccccaacgcccctgaaggcaggggaacagaaaacctggctgtggccatggaccctccaagccccccattgccgatggttggctatcgtagccccctgtggggagggcctacagtatgacttacatgtcactccttgggtatttaatgtatggcctccgcgattgaccgttcataggggaatggccagggaaggaaccctcctccgggggacatatgtactgtctgtgtggcctattatgagctcccctgtgactttggcacggatacaggacccaaaggaaccatggggagctgagaaggtgtggtaccattgcccagggcagaagcccttggtggctgcattgttatccagggatgaaaggttggcctgtattttgcctgagggacgtgatttacccctgttagtacctgtgcctgctttgtcatttcgaccgtaggttgacatgctccaacagcattgtggactgggcccacacctacactgaggtgaccaatgtttccaactgttggatctgcaccgcccttccagcagcagctgcggatggcttgccctggcacatacatccagcttctgcggagaactggacatggctagagacttggggtcccatggccgacggttggaatgcaacacggcaagctttggatagggggtgccgcaaaacccacattgcaatgcctgccccctggctgacccatagcatttatgatggatggggctggctagtgggagaacatgtggtgcccccagcgcaggcaccatgatgtatagagcaacattggggtaatgtcaccgtggggtggttgcccgccacagcctgtgcaaacataacacatgtcaccacaccaaaggtgtggtggaacaagcggcctcaccaaggctgggccccgatggactttgtgccccctgggagtttatgggtctgtggggacacaggatggccatatctgccagcgaattggactggatgttgtacctgggggtggccttatgtgcctgccactgttcttcccacattgcctaggtgcccgcataactgggaggcgctacgttcccggtttttgcgagtgcgacgagccccctggtggttctaccccttagcagtaactatccttggagcgggtgtcatcactgtagaaatgcaagttacagcccttgcagagcacacagctcaggccctgaattacacccgagttgccctccttctgttaacggatgaggttgatcaaatcaggaaggtggtgctgcaaaaccggatggtcttagacatagtaactgctgcccaaggtggcacctgtgcccttttaggaacacaatgttgtacctttatccctgacaatcaccagaacataacagcagctttgcaaggggtgtcacaggagattaaggcggttgagagccttactgatgaccccctgcagagatggtgggcatccctgggctctggcctacgctgggccctaataatcataggtagcatagcgggaatattagtggtgagttgttgctccctgtattgttgctgtggcctatgggtccagggttccaccctatgggcacgtgtccccactaggaggactccctcggcctagggggtgga

SEQ ID NO: 23 - DNA, 4843 bp, Homo sapiens
  repeat_region (1)..(4843): herv23
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttttggtgatgcctatgggacccaaagtggggttccagcaatccctatcacttcactgaaaattgaagccttggtaccgtcatgaatgactttcattgacctgacctcgccaatgtcaacagggatcactgggcaggcccctctcaggatctgcatctttctagcttggctgagaattcagactttatttgagccatacacattcctaacttgacaagtttggaattgaagtctactttaaggcataaattttatttgttattctctggagattgcggagttgtgattttcacttttctctgatgttaaggttttgtgttgaattactcattagagtttttataaccttttctctcattcaaatcttggtcagggagaaaaatagattctctcccttaaaagaggaagtggatatttgtggcttaagcaaaatttataatctttaaaactggccagattctgaaacttgaatcaaatgatgaatctaaactttcttttgactgaccacaattcctcacgctaggtctttttggccattcaaaggaataatctaaattatggtgagtcatacttctataactgggacttctttaagaagagatccagggacgaatccttgatttttaaagatctagatgtgttgccttccagctgtgcctgcttttcacatattaaatattaggccctggccctggaccatgagaacgagctctttcccctattcgttaaaaggctccactctgaagtcagtaaactcataaaaaaacaagctaaattgaaaagaccaactgtctacccaggtaagtctccaaaatatggctttttggcatttagctggctgttttgaaacgctttgtaaaagaaatgtatatctataaattaaatctccatttgtaagggcatctcccttactgtaactaaactgctagaaacatttaagttgaggaacacattgcataacaaactttacctttatttaaggtacttttcctagaatcttggcttgactaggcctttacctatgcctttctttgactcagcaaataatattgtatagatctaagttctgtgcctttgggatgtaaattttcacctaacattcatgtcttcggaggggtgaatttatggtcacctagctaacaattgtttacggcttggtagtctaaagagagaagagaaactctttgaaaactggccaatgaagtaccttataaagctatcaaatcttctgtctgtgtatctgtatgtctacgttgtcaatcaagaataatgacccatatgtttatatgaatcatgtgtatattatatgtaactaccaaattatatgaatctaattaactggcttgaagaaaaagaaaccacataaatcaaatattttattagaaaaacagaaactaactcaaatgccatttagttcacatgacttgggtcatctttcataagtaagacttgtttaatattgctggtttgatgaaaacagttgtgtattctgatcagcaaaatacccatgcatttacctatagagttcttgcttaaatggtaactacctattaataacattcacatactattaaaatgactatcaaaaaaacttgagatgaagactagcttaatttaatgagcaattcaggtataattgttaagaatgaatgaattaaacaaatataaatggaataaatgtttataaataaagtatccattgtttagaaatcattcagtaacttaatattaaagtcatattatgttaaattaagtaatatgtaatcataaagtgtctgagttgcttatatggtatagaaaagagaaacatatttatatttcttaataaaccaaaaaagaaacatttttctaaaaattttgaaatggtttttaactacaaatactcatataaaacagttccaaattacttatttcctagatttttcccagaaaattagggtttataatagttaaaattatagttaatttatatatgtaattaagactagtagatatatgagatacaactcaatatacaaggtatatgaagaaagtcaaatatatttttggtaaaataagatgaaaggagatagtgatatttgtgtgtttgcttggcagaagaaagaactttgtgtggtcaaaatgataagggataaaggaaagtacatttttattctatgatagaatggcaatatttttaaaaaggtataataggataaaattggaggttaaagccagttatataaggtttgtggaagattaagctcatgaaaggaattttgtctgtgattgaattggctaaaattagaagaaaattatttataaggtttttctaaaaattgagcattaatataaaaaacacattaatttaaggccagagtctgggctcctgtgtcagaacaacaattttctcagagcattgatctgttccttaatagaaaattgtaagaggttataaaacatttatggaaatcttatcttatatggtcaaagttgactgagattggatgaatttggtattaaggttttattaaaattagctttagtagtggtaatacagtaatataaaagtaaattttctttttttccctttgaataagattttatgtagtattaatgagagataagatttgtttacctcttgagtaaactacagaaaaaaagggaagagtttatttcatgctgtcattattaggtctcttgattgggaactgggtctcctctctatcaaagagtaaaatttttgctgtttgaaatcttaatctttgaattagtatattggctaaataaatgactgttattttacagtctgtgatcctaatttactatgtgttttaaacctttttaattttaatattaaggtttttaaacctttaatatttgagattcttaaaattacattttaaattctgaagttatctttctgacccaaactgatgaagataattaataaaaactctggaaatccaagagagacatattaaacttctttcatacagaaagaaatgtcaaataagaaattatgtttaagtttcttagagttatatttgtataaatgtgttattaatgtgtgtttcaaaattgaaaaagatgcctaaaattatatcttggaatacattatcagtcataattatgattatgttaaactgttgtattactacaaaaaatagccaattttctgtcaattgcatatttaaccaaaccatgacaattcaaagttttttgtcattcatggacagttattgttttactttgattcttctcaaaaagtagtttatgatcaactgctgtctaaaattggtttcttctgaaaggaaattcatggaagaggatcctgacaagtactcttcagtacaggtttctgataactttagagataataccactgaagtaagtaaaaacttctagaactctaacaaaaactgatgtagtcatgaagattgccaacctaacatcgttaagcagaaaaataattacttacatgggactaagctgatagagaattaaaattatttttatggcatttttgtttgaaccattgttgattctttctaaattttgcttttcagagtcaagaaaacagttttttttagccatttatagcttacagcaattgggtatagtataattttgtgaacaaaactgaaacagttacccttccttctatgtggtttctccaaaatttgaaaactattcatgagcattcttattttatggcaatataatttcataatttcaataaaaagatgctttcttttccaacagaacacattggagacattggtaattttaccaatgttttgtctggaacagtgtattttcagatataaccagtctgctttgagaaattaaagccacatggaaagaatggcctggaacctagtttacacagtttccttacaaggttccagaccttgtagtaaataatgaatatcactttctgacaggctcaggaaactcaagatatttggggactacaagaagagagaaattcactcaatttgtacaggtattgtaagtaccattttatggtgactctttggcttcgcttccttgcctagagataattttaatagtctaatatgaatcttctaatgaaaaatttccagcaaagccaacttaaatttccagcaaagcctgcaggaccagtcactgttcttgtgaatgtttatgcaatgaccaggccaagtataatactaaaacttattttgcaattaaattggtcctactactatttatctttggtagaaatggaaaattggagagagaaaagaatgtgttttagaagaaaactgtagcacacttgttattagattacagccctgactattatttttgagtttttattattttcctacaactcagactaaattctgaagtatttcctggctacaagactctaaagaaaatctgggtgttaatttttttttattatgtttttagttgactcctcaatagaacagttgttttgttgttgttgctctggtacacaatatttttgttataatcctatgtgtgttataattctgctatgtatctcctgttgtttgacttcttttaagaaaactaaacacatgatattctaaagactaaagatgattcaacaagtgatagcaactatgtaaatcagtgacttgactggtcttatttttgtgaacctatgaggccattccaatttgtattttgaagctcttagaattcctcaatgagacatgtcctgtccccccaaccatgtgagatagagccatctgggaatgagctttactagcaatgcaggactaagattctcaacataaaaagagccaaaagcatttgagtttatctatgatgctttcttcaaaagatatttatgaaaaggggggaa

SEQ ID NO: 24 - DNA, 2799 bp, Homo sapiens
  repeat_region (1)..(2799): herv3
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ctgggtattcgccctatgaaagactgttcggcaagccatccccaatcataagtcaaattaagggtaatcttcgtgaactaggggaattaactttaaggaggcaaatgcaggctttagggatagccatgtgaagtgtccatggctgggtacaggaaagaatgcccataagcctgatagatccaatacacccctttaaacccagggactctctttgggtcaaaaaataaaacccaaccactctgggacccatatgggatgggctccatactgtaatcttgtctattcccactgttgttaaagttgcaggaattgtgccttggatccatccatccagtcagctgaaaccagcagcccaggacaagtggaccagccaacaggacctagaccatgcaacccagctgatcctacgatggaaccaaggtgccagtgagatgacaacagccctgctctggtcactccggaagctgaccagtccacgcacggctgaagcttgaggagacaacagccctgctctagtcaccccagaagctgactagtctatgcacggccgaagcttgagtcatcatcagggaagtaaatgtggttagaaatctgaagtccagtaattttccttgtcatattaattactttgctattaagctgtcactttgcttagccttctccccccaggaaaaagccttttctgtccatgctgggtatgaacatgctactcatcactttgttcttgctactccccttatccatgttaaaaggagaaccctgggagggatgcctccactgcacccacactacgtgtcggggaacatcatgactaaaaccctgttgtatcacacttattatgagtgtgctgggacctgcctaggaacttgtactcacaaccagacaacctactcagtctgtgacccaggaaggggccagccttatgtgtgttatgaccctaagtcttcacctgggatctggtttgaaattcatgtcgggtcaaaggaaggggatcttctaaaccaaaccaaggtatttccctctggcaaggatgtcgtatccttatactttgatgtttgccagatagtatccatgggctcactctttcccgtaatcttcagttccatggagtactatagtagctgccataaaaataggtatgcacaccctgcttgttccaccgattccccagtaacaacttgctgggactgcacaacgtggtccactaaccaacaatcactagggccaattatgcttaccaaaataccattagaaccagattgtaaaacaagcacttgcaattctgtaaatcttaccatcttagagccagatcagcccatatggacaacaggtttaaagacaccgctaggggcacgagtcagcgatgaagaaattggcccaggagcctatgtctatctatatatcataaagaaaactcggacccgctcaacccaacagttgcgagtttttgagtcattctatgagcatgttaaccagaaattgcctgagccccctcccttggccagtaatttattcgcccaactggctgaaaacatagccagcagcctgcacgttgcttcatgttatgtctgtgggggaatgaacatgggagaccaatggccatgggaagcaagggaactaatgccccaagataatttcacactaaccgcctcttccctcgaacctgcaccatcaagtcagagcatctggttcttaaaaacctccattattggaaaattctgtattgctcgctggggaaaggcctttacagacccagtaggagagttaacttgcctaggacaacaatattacaacgagacactaggaaagactttatggaggggcaaaagcaataattctgaatcaccacacccaagcccattctctcgtttcccatctttaaaccattcttggtaccaacttgaagctccaaatacctggcaggcaccctctggcctctactggatctgtgggccacaagcatatcgacaactgccagctaaatggtcaggggcctgtgtactggggacaattaggccgtccttcttcctaatgcccctaaaacagggagaagccttaggataccccatctatgatgaaactaaaaggaaaagcaaaagaggcataactataggagattggaaggacagtgaatggcctcctgaaagaataattcaatattatggcccagccacctgggcagaagatggaatgtggggataccgcaccccagtttacatgcttaaccgcattataagattgcaggcagtactagaaatcattaccaatgaaactgcaggggccttgaatctgcttgcccagcaagccacaaaaatgagaaatgtcatttatcaaaatagactggccttagactacctcctagcccaggaagagggagtatgcggaaagttcagccttactaactgctgcctggaacttgatgacgaaggaaaggttatcaaagaaataactgctaaaatccaaaagttagctcacatcccagttcagacttggaaaggatagtctccagattcccttttcagaggttggttcttatcccttggaggatttaaaaccttagtacaaatagtcctagccatattgggagtttgccttatactcccttgtctcttacccctcattgtcaaaaatatccaaacagccatagaggctcttgtggacagacggactaccacacgactaatggccctaactaagtattaacccctgccaagaaaagagctacttcctcttgaagtaaatgaagatagtgatgctttctcttaaactttacttataaaaagcatcaaaggggggaat

SEQ ID NO: 25 - DNA, 833 bp, Homo sapiens
  repeat_region (1)..(833): herv49i
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gtctgaaaatggctgggaacccgagacacataagattttaagcagcacactttttgttctgaatgtgtcaagctctcaggagggtttgtcttaagaagtcccatccataaggggcttttgtcatctcaacccttgttgcctggttagtcctgggaaagtccaatcccaggagggcctacccggtgtcacggattaatgggtctgtgactggcagccccccacaaatttgtgggttactggaggcaccgtacgcacaaacaccatccttaaccatctgtggcaacaagagtcttttgctatcttagcctattcctgggagtaaattttttgagaatcattgggattgcctcttctatgccctctccaggaacacctcttgcttatatggtaaaagttattctaaacctggaaaattaccttttgggctttccatgaagaggcttattggattgagtcgctattggaataagtacaccattgaaaattctaattgtcaatggccaaaagatggatcctttaaattagaaagactcctaaatttaaaaaaaaaaaggattttagagatctcttattctaaacaattgccttatttgtattgatgggaagatcaaatttaaaaaaagacacataatagtgtcatggctagccttaaaaattctcttgactaaattaaagagcaaaaatctgacctaaaacaaagttaaaatcttttgtacgctcaaactgcccgctttggattccctgcgggattaacaatgaaggccactccatcttgtagtctggtggttaaaattccatactttcaccaccatggcctgggtttgattctcggt

SEQ ID NO: 26 - DNA, 8399 bp, Homo sapiens
  repeat_region (1)..(8399): herv9
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttttggcaaccacgaagggactatcacctatcgccaagcggtgagactattgcatagcgccaagcagtgagtaccatcagacccctttcacttggtattctgtcctatttttccttagaattcaggggctaaatactgggcacctgtcagccagttaatagtgactagcacggccactggactaaaaacacgggtgtcaggctttctgggaaagggctctctaacaacccttgactctttggagttgggagcgttggtttgcctggaaccagcttccacttttcctatacttctaggctgagccaagggtcaacagagaggaaagccatttagctctgggggtcccgaaaacaagttggttgaccctgcagtcatgagcggaactctcaaagtcatgtcacccaagcgagacttgcccatctattctatctaccctgacccttgcctcctgggtcctaatgcctgccagacaaacttcctctcacctctcttctccaaggctagtcctgcttctaaaaaccactccctgtctctggtgcttttctagtttctcctataagaatgatttctagtataaactccaggaatctattcccttctttaggcaactgggctcaccaatcagaaagacataattttttcccaaagccctgtcgcagtggggactatctggaattttaggatccttccttagaatagcaggcctaacgaaagctattcctgaagctaggatatggggagcctcataaattgtatccttcctattcatataaatgaggacaaaaggcatcactcttccaactctggagatcccttccctccctcaggttatggccctcaacttcatttttggggcataacatctttataggacacgggtaaggtcccaatactaacaggagaatgcttaggactctaccaggttttcaagaatatgtcataagggtcaccaaatcctatttttctcggtcctttttgtggtctaggatgacaggcaagggtacaggtttttgagaatgcatcggtaatggccactaaatcctaccttcctcggtcctccttgtggtctaggaggaaatctagtgtttctgatgctgtgtcggtgagcacaactattccaatcagcagggtccagagactgttgccagttcttgggcaggggttgtttctgctgctgcatcggtgattgcaactattctgatcagcagtgtccagggaccattgtgggttcttgggcagggggagaaacaaaacaaaccaaaactatgggcggtttgataggaaacactcaggcatcaacacgctcacccttgaaatgtatcctaagccattgggaccaatttgacccacaaaccctgaaaaagaggcagctcatttttttctgcactacagcctgaccctaatattctctctctgatggggaaaaatggccacctgagggaagtataaattacaatactatcctgcaggttgaccttttctgtaagagggaaggtaaatggagtgaaataccataaggtattacaagctttcttttcactgaaggagaatacacaactatgcaaagcttgcaatttacatcccacaggaggacctttcagcttacccccatatcctagcctccctagagctctccttcctattaatggcaagcctcctccaatctcccctgcccagaaggaaataagcaaagaaatctccaaaggaccacaaaaacccctgggctatcggttatgtccccttcaagctgtagggggtggagaatttggcccaacccaggtacatgtccccttctccctctgtgatttaaagcagatcaaggcagactgggggaagttttcagatgatcctgataggcacatagatgtcctccagggtctagggcaaaccttcgatctcacttggagagatgtcatgctattgttagatcaaaccctggcctttaatgaaaagaatgtggctgtagctgcagcctgagagtttggagatacctggtatcttagtcaagtaaatgatagaatgacagccgaagaaagagataaattccctactggccagcaagccatccccagtatggatccccactgggacctcaactcagatcatggggactggagtcgtaaacatctgttgacctgtgttctggaaggactaaggagaattaggaaaaagcccatgatttattcaatgatgtccaccataaatcagggaaaggaagaaaatccttctgccttcttcaggtggcttcaggagaccttaagaaaatatactccactgtcacctgaatcactcgagggtcaattgattctaaaagataagtttattacccaatcagcagcagatatcagtagaaagctccaaaagcaagccctgggccctgaacaaaatattgaggcattattaaacctggcaaccgtggtgttctataatagggaccaagaggaacaggcccaaaggaaaagagatcagaaaaaggccgcagccttagtcatggccctcagaccaacaaactttggtggttcagagaggacagaaaatggagcaggccaatcagctggtagggcttgttatcagtgtggtttacaaggacactttaaaaaagattgtccagtgagaaacaagctgcccccttatctgtgtctactatgccgaggcaatcactggaaggtgcactgccccagaggacaaagtttctctaggttggaagcccccaacctgatgatccaacaacaggactgagggtgcccagggcaaacgccagctcatgtcatcaccctcactgagccccaggtatgtttaaccattgagggccaggaaaatgacttcctcctggacactggcacgtccttctcagtgctaatctcctttcctggatgactgtcctcaaggtctgttaccatccgaggaatcctggggcagcctgtaaccaggtgtttctcccacctcctcagttgtaattgggagactttgctctttctgtatgcctttcttgttatgcctgaaagtcccacacctttattagggagatatattagccaaagctggagctattatctacatgaatatggggaacaagttacccatttgttgtcccttacttgaggagggaattaaccctgaagtctgggcattggaaggacaatttggaagggcaaaaaatgcccacccagtccaaatcaggctaaaagactccaccacttttccttatcaaaggcaatatcccttaaggcctgaagctcttaaaggattacaggatattgttaaacatttaaaagctcaaggcttagtaaggaaatgcagcagtccctgcaacaccccaattctaggagtacaaaaaccaaatggtcactggagactagtgcaagatcttagactcatcaatgaggcagtaattcctctatatccagttgtacccaacccctataccctgctttctcaaataccagaggaagcagaatggttcatggttctggacctcaaggatgccttcttctgtttcccctgcactctgactcccagtttctgtttgcctttgaggatcccacagaccacacgtcccaacttacatggatggtcttgccacaagggtttagggatagccctcacctgtttggtcaggcactggcccaagatctaggccacttctcaagtccaggcactttggtccttcagtatgtggatgatttacttttggctaccagttcagaagcctcatgccagcaggctactctagatctcttgaactttctacctaatcaagggtacaaggcatctaggtcaaaggtgcagctttgcttacagcaggctaaatatctaggcctaatcttagccagagggaccagggccctcagcaaggaatgaatacagcctatactggcttatccttgccctaagacattaaaacagttgcaggggttccttggaatcaccggcttttgccgactatggatccctggatacagtgagatagtcaggcccctccatactctaatcaaggagacccagagggcaaatacttatctagtagaatggtaaccaggggcagaaacagccttcaaaaccttaaagcaggccctgtacaagttccagctttaagccttcccacaaacttctctttatatgtcacagagagagcagggatagctcttggagtccttactcagactcttgggacaaccccacaaccagtggcatacctaagtaaggaaattgatgtagtagcaaaaggctggcctcactgtttaagggtagttgcagcactggccatcttcatgtcagaggctatcaaaataatacaaggaaagatctcactgtctggactactcatgttgtaaatggcatactaggtgccaaaggaattttatggctatcagactaccacctacttagataccaggcactactccttgagggaccagtgcttcaaatatctacatgtgtggccctcaaccctgccacttttctcccagagaatggggaaccaattgagcatgactgccaacaaattacagtccagacttatgccacccaagatgatctcttagaagtccccttagctaatcctgaccttaacctatataccgatggaagttcatttgcagaaaatgggatatgaagggcaggttgtgacatagttagtgatgtaactgtacctgaaagtaagcctcttcccccagggaccagcacccagttaacagaactagtggcacttacctgagccttagaactgggaaagggaaaaagaataaatgtgtatacagatagcaagtatgcttatctaatccctcatgcccatgctgcaatatggaaagaaagggagttcctaacctccgggggtacccccattaaatgccacaaggagattatggagttattgcatgcactgcaaaagcccaaggaggtggcagtcttacactgccaaagccatcagaaaggtgaaggagaaaaggcagaaggaaaccgtcaggcagatgctgaggccaaaattgctgccaggtggatactcccattagaaatacctatggaaggacccttggaatggaacaaacccctccaagagattaagccccagtattccccaaatgaaacagaatggggactctcatgggggcatagttttctcccctcagggtggttaacgacaaaagaaggaaaggtacttatacccgaagccagccagtggaaaatacttaaaaccctccaccaaacttttcatatgggtattgaaaacactcatcaaatggccacatctctattcacagggccaaatctactctgggccttccaacaggtagtcaaaacctgtgaggtgtgccaaaggaataatcccttggtccattgtaaggcccatttgggggaacaaagaataggtcactatcctggagaggactggcagttagacttcacccatatggcctaaatcaaagggatttcaatacttgttggtctgtgttgatacctttacaaattggatagaagctttcccctgcaagacagagaagactcaggaagtgattgaagtcctaattgatgaaataattcctagatttgggcttccctaaggcttacagagtgacaatggtccagttttaaagccacaataactcagggaatgtccaggctgctagggatacagtatcaccttcactgcgcccggaggccacaatcctcagggaaggtcaagaaggcaaatgaaacactcgaggcacttaaggaaactaacacaaggaacatctcccatggcctactcttttgcccatggccttgttgagaatccgaaattctcctcacaaaatggggctcagtccatatgaaatgctgtatggacaacattttctcacaaatgacctcctacttgatgaggaaaagacaaacttgttcaaagatataacttcttcggcaaaatatcaacaaaaccctaaaaacctacctgaaggatgtcacagagaaaagggaacagagttgtttcaaccaggagatctagtgttggtcaaatctctcccctctacctccccatctatggactctctgtgggaagggtcatactcaataatcctctctacccacactgcagttaaggtggtaggagtgaaatcttggattcaccacacccgagttaaattttggacatcccctgaggaacctgtgagaccatcagctcaggagtcccaagatcagccagaccagcctcaatacacctgtgaaccattggaggacttgcatctcctatttcggaaggaaacatcccagaataaaatggctcctaccactaatcctgaggaaaaaccccttcctccttaaaaaagataagtgaaaacctacataatctttatctttaatacctctccttgcccctttaatggaatccttttactatttcatcatattattaagcagcatactaaccatactctttgtgataggactatatactgtagctcctgccaggatgaaaatcctaatcacatcaaccttctttctatcatccttccttgtgacagcaatttactcctacctttaactcagcctggaaaaaatgatgtcatcttccagagcaccctctttacctttctatttactctttgcctatctatccctcctgcttccttggatacctcatacaatcactgctccccttccactagctcctaattacctctacaagactctcaacttaacccactgtctgttaaaccagtccaatccttccctggcaaatgactgttggctttgtatctctctatcaacctctgcttatgatgccactcccagtcccataaaaaacttggtctttaccaacttaatctaccaccctcattatgaaggaaaagaccttttctgacttctaaatatgcaatcattagctgacttacccatctctgataggaccaagaataccctaacaggaggcgcaatccaacttttacgttcttacatttccaacctcaactattacacaagcaatgaaaagcccatacacagccctgtaactatgaataccatcttaactttccaagcccctttatgcatccaatgcaacctgttatcaggcctgcccctggggcacttactaccccatcagtgtaattaaaccctacaacttcaagccccaactgatcatagtaacttctgagtcacccaaacagctccattcaaatggtttgtctgctcagggcccccaaaaatcatcacctcctccctgcttaacaaacagtccaggttttgtaatggcaaacatattccctgcatgaccattcacccctggacaccctgcagcagcacccccactactagtgaatgccttctcatcccctctttcagtcactctctcaaatggttcctagtagatacaaaatggtttttttctccaatgggaaaatagaacacagggagctcccaatacccctttccagccacttactggagctaccttggcaagtactctaggagtatggataaatgaaaacaacaaattcacacacctttttaatatacacaaccaattctgtctacccagccaaggtatattcttctaatgtggaacatcgacctatatttacctccccactaactggacaggcaactgcaccttagtctttctaagtcccaacattaacattgccctaggaaatcagaccctatcagtacccctcaaagctcaagtctgtcagcacagagccatacaactaatacccctacttatagggttaggaatggctactgctacagggagcagaagagccagtttatctacttcattatcttactaccacacactctcaaaggatttctcagacagtttgcaagaaataatgaaatctatccttactctacaatcccaaatagactctttggcagcagtgaccttccaaaactgcagaggcctagacctcctcactgctgagaaaggaggtctctgcaccttcttaggggaagtgtattgtttttacactaaccagtcagggatagtaagagatgcttcctggcgtttacaggaaaaggcttccgaaatcagacaatgcctttcaaactcttataccaacctctggagttgggcaacattgcctctcccttttctaggtcctgtggcagccatcttgctgttactcgcctttgggccctgtatttttaaccttcttgtcaaatttgtttcctctagaatcaaggccatcaagctacagatggtcttacaaatggaaccccaaatgagttcaactaacaacttctaccaaggacccgtggaccaacctgctggcccttccactggcctaaagagttcccctctttaggacactacaactgcagggccccttctttgcccctatccagcaggaagtagctagagcagtcattggccaaattcccaacagcagttgtggtgtcctgtttaggagggagat

SEQ ID NO: 27 - DNA, 7813 bp, Homo sapiens
  repeat_region (1)..(7813): herve
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tttcttggttccctggccaggaagcaaggtaattgaaggacagtcgaggcagccccttaggtggcttaggcctgccctgtggagcatccctgcaggggactctggccagcttgagtgacgcggatcctgagagcgctcccaggtaggcaattaccccggtggaaagcctcgtcagagagtgcgtggcaggcccctgtggaggatcaatgcagtggctgaacactgggaaggaacaggcacttggagtccagacatttgaaacttggtaagactggtcttcggaacttgcccactccatttgagtggaagcgtggcctgatcaaccacggcatgcctgtactggcactttggtttttgtttttgacttgacttgaattgcttgatactttggttttggtttgacctggcttggatttctggatactctgattttggttttgattctggtttggtgaaaactgaaaaagtgtgtgtgtgcactttttacccattctttgttttgtggtgtgcatgtggtgtgagcttggtgttttgtcttgaggaaacatggatcagacacaaaataagcctactcctctaggaactatgttgaaaaattttaagaagggatttaatggagactatggggttactatgacaccagggaaacttagaactttgtgtgaaatagattggccaacattagaagtgggttggccatcagaagggagcctggacgggtcccttgtttctaaggtatggcacaaggtaactagtaagtcaggacactcagaccagtttccatacatagacacttggttacagctggtgctagaccccccacagtggctaagagggcaggcagcagcagtgctagtagcaaagggacagatagtcaaggaaggattctgctccacccgctgagggaaatcaactcctgaagttctgttcgaccaaacatcagaagatccattgcaggagatggcaccagtgatcccagtgttgccctccccttatcagggagagaggctccccacttttgagtccacagtgcttgcgcctctgccagacaaatgtatccctaggccactcagagtagacaagagaggaggtgaagcctcgggagaaacccctcccttggcagctcatttaagacccaaaacagggatacaaatgcccctgagagagcagcagtatactggaatagatgaggatgggcacatggtggagagtcgtgtttttgtgtaccagcccttcacctctgccgaccttctcaactggaaaaacaataccccgtcctatactgaaaagccgcaagctctaattgatttgctccaaactattatccagacccataaccccacttgggctgattgccaccagttgctcatgttcctctttaaaacagatgaaaggtgaagggtgcttcaagcagcaactaagtggctagaggaacatgcactggctgattaccaaaacccccaagagtatgtaaggacacagttaccaggaaccgacccccagtgggacccaaattaaagagaggatatgcaaaggctaaaccgatacaggaaagctctcttagaaggtttaaagaggagagcccagaaggccacaaacattaacaaggtctctgaggtcattcagggaaaagaagaaagtccagcaaaattccacgagagactgtgtgaggcttattgtatgtatactccctttgatcccgatagccctgaaaatcaacgcatgattaacatggctttagttagtcaaagcacagaagacattagaagaaaactgcagaaaaaggctgggtttgcagggatgaacacatcacagttattagaaatagccaaccaggtgtttgtaaacagggatgcagcaagccgtaaggaaaccacatagagaatgaacgtcaggcccggcgaaacgcgcctgttagctgcagcaattagaggggtccccccaaaagaggcaaggcaaaaggggggccctgggaaagaaactcagcctggctgtcagagcttgcagtgtaatcagtgtgcttatcgtaaagaaataggatattggaagaacaaatgccctcagctaaaaggaaaacaaggtgactcggagcaggaggctccagacaaggaggaaggggccctgctcaacctagcagaagggttattggactgagggggactgggctcaaggacctccaaagagcctatggtcaggatgacagttgggggtaaagacattgattttcttgtagataccagtgctgaacattcggtagtaactgcctcagtcgcccccttatccaaaaagactattgacatcatcggagccatgggagtttcagcaaaacaagctttctgcttgccccagacttgtactataggaggacataaagtgattcatcagtttttgtacatgcctgattgtcccttgcccttgttgggaagagacttgcttagcaaactgagagccactatctcttttacagagcacggctctttgctgctaaagttacccggaacaggagtcattatgacccttatgctcccccgagaggaggaatggagacttttcttaactgagccgggccaagagataagaccagctctggctaagcggtggccaagagtgtgggcggaagcgaaccctccagggttggcagtcaaccaagcccccgtgcttatagaagttaagcctggggtccagccggttaggcaaaaacagtacccggtcctcagagaagctcttgaaggtatccaggtccatctcaagtgcctaagaacctttagaattatagttccttgtcagtctccatggaacactcccctcctgcctgttcccaagcctgggaccaaggactacaggccggtacaggatttgcgcttggttaatcaggctacagtgactttacatccaacagtacctaacctgtacacattgctggggttgctgccagctgaggacagctggttcacctgcttggacctgaaagatgctttctttagcatcagattagcccctgagagacagaagctgtttgcctttcagtgggaagatccagagtcaggtgtcactactcaatacacttggacccagcttccccaaaggttcaagaactcccccaccatctttggggaggcgttggctcgagacctccagaagtttcccaccagagacctaggctgcgtgttgctccagtacgttgatgaccttttgctgggacaccccacggcagtcgggtggccaagggaacagatgctctactccggcacctggaggactgtgggtataaggtgtccaagaaaaaaagctcagatctgccgacagcaggtatgttacttgggatttactatccaacagggggagcacagcctaggatcagaaagaaagcaggtcatttgtaatctaccggagcctaagaccagaaggcaggtgagagaattcttaggggctgtgggtttttgcagactgtggatcccaaactttgcagtattagctaagcctttgtatgaggtcacaaaggcgggggaccaggaaccttttgaatggggatcccagcaacagcaagcctttcatgagttaaaggaaagacttatgtcagtcccagccctggggctacctgatctgacaaagccttttacattgtatgtgtcagagagtgaaaagatggcagttggagttttaacccaaactgtggggccctggccgaggccggtgacctacctctctaaacaactagacggggtttctaaaggatggcccccgtgtttgagggccttggcagcaactgccctgctagtacaagaagcagataagctgattcttgggcaaaacctgaacataaaggacccccatgctgtggtgactttaatgaatactagaggacatcattggctaacgaatgctagacttactaagtaccaaagtttgctttgtgaaaatccccatataaccattgaagtttgtaacaccctgaaccccgctaccttgctcccagtattagagatccctgtcgagcatgactgtgtagaagtgttggactcagtttactctgggcatcagtagactgggaactatacgtggatgggagcagctttgtcaacccacaagaagagagatgtgcagggtatgcggtggtaactctggacactgttgctgaagccagatcgtttccccagggcacttcaactcagaaagctgaactcattgctttaattcgggccttagaactcagtgaaggtaagactgtaaacatttacactgactcttgatatgtctttttaacccttcaagtgcatggagcattatgtaaagaaaagggcctattgaactctgggggaaaagacataaaatatcaacaagaaatcttgcaattattagaagcagtatggaaaccccacaaggtggctgttatacattgcggaggacaccagtgagcttccaccttggtgggtttggggaattcctgcactgacttagaggctcaaaaagcagcatctgcccttccgggcatcagtgacagcccccctgctccctcaagcacctgatcttgtacctacttattctaaagaagaaaaggactttctccaggcagagggaggacaagtgatggaggaaggatggatttggttaccagatgggagagtagctgtgccacagctgctaggagctgcagttgtactggctgtgcataaaaccacccatctaggtcaggaatcacttgaaaagttgttaggctggtatttctacatctcgcatttgtcagcccttgccaaaacagtgacgcagcggtgtgttacctgccgacagcataatgcgagacaaggtccagctgttccccctggcatacaagcttatggagcagccccctttgaagatctccaggtggacttcacagagatgccaaagtgtggaggtaacaagtatttactagttcttgtgtgtacctactctgggcaggtggaggcttatccaacacgaactgagaaagctcatgaagtaactcgtgtgcttcttcgagatcttattcctagatttggactgcccttacggattggctcagataatgggctggtgtttgtggctgacttggtacagaagacggcaaaggtattggggatcacatggaaactgcatgctgcctaccagcctcagagttccggaaaggtagagcggatgaatcggactatcaaaaatagtttagggaaagtatgtcaagaaacaggattaaaatggatacaggctcttcctatggtattatttaaaattagatgtaccccttctaaaagaacaggatattccccttatgaaatattatatcataggccccctcctatattgcggggacttccaggcactccccgagagttaggtgaaattgagttacagcgatagctacaggcttcaggaaaaattacacaaacaatctcggcctgggtaaatgagagatgccctgttaacttattctccccagttcaccctttctccccaggtgatctagtgtggatcaaggactgaaacgtagcctgtttgtgtccacggtggaaaggaccccagactgtcatcctgagcactcccaccgctgtgaaggtagagggaatcccaacctggatccaccacagccgtgtaaaacctgcagtgcctgaaacctgggaggcaagaccaagcccagaaaacccctgcagagtgaccccgaagaagacaacaagccctgctccagtcacacccggaagctgactggtccacgcacggccgaagcatgcagaagctcatcatgggattcatttttcttaaattttggacttatacagtaagggcttcaactgatcttactcaaactggggactgttcccagtgtattcatcaggtcaccgaggtaggacagcaaattaaaacaatgtttctgttctatagttattataaatgtataggaacattaaaagaaacttgtttgtataatgctactcagtacaatgtatgtagcccaggaaatgaccgacctgatgtgtgttataacccatctgagcctcctgcaaccaccatttttgaaataagaataagaactggccttttcctaggtgatacaagtaaaataataactagaacagaagaaaaagaaatccccaaacaaataactttaagatttgatgcttgtgcagccattaatagtaaaaagctaggaataggatgtgattctcttaactgggaaaggagctacagaataaaaaataaatatgtttgtcatgagtcaggggtttgtgaaaattgtgcctattggccatgtgttatttgggctacttggaaaaagaacaaaaaggacccggtttatcttcagaagggggaagccaacccctcctgtgctgctggtcactgtaacccactagaactaataattaccaatcccctagatccccattggaaaaagggagaacgtgtaaccctggggattgatgggacagggttaaacccccaagttgccattttaattagaggggaggtccacaagtgctctcccaaaccagtatttcaaaccttttataaggagctgaatctgccagcaccagaatttccaaaaaagacaaaaaatttgtttctccaattagcagaaaatgtagctcattcccttaatgttacttcttgttatgtatgcgggggaaccactatcggagaccgatggccttgggaagcccgagagttggtgcctactgatccagctcctgatataattccagttcagaaaacccaagctagcaacttctgggtcctaaaaacctcaattattggacaatactgtatagctagagaagggaaagactttatcatccctgtaggaaagcttaattgtataggacagaagttgtataacagtacaacaaagacaattacttggtggggcataaaccacactgaaaagaatccatttagtaaattttcaaaattaaaaactgcttgggctcatccagaatctcatcaggactggatggctcccgctggactatactggatatgtgggcacagagcctacattcggttacctaataaataggcaggcagttgtgttattggcactattaagtcgtcctttttcttattacccataaaaacaggtgagaccctaggtttccctgtctatgcctcccgagaaaagagaggcatagttataggaaactggaaagataatgagtggcgccctgaaaggatcatacagtattatgggcctgccacatgggcacaagacggctcatggggataccgaacccccatttacatgctcaatcggatcatacggttgcaggccatcttagaaataattactaatgaaactggcagagctttgactgttttagctcggcaggaaacccaaacgaggaatgctatctatcagaatagactggccttggactacttgctagcagctgaaggaggagtttgtggaaaatttaacttaaccaattactgcctacaaatagatgatcaaggacaggtggttgaaaacatagtcagggacatggcaaaggtggcacatgtgcctgtacaggtttggcacaagtttaatcctgagtctttatttggaaaatggtttccagctataggaggatttaaaaccctcattgtaggtgtattgctagtgataggaacttgcttgctgctcccctgtgtattacccttgctttttcaaatgataaaatattttgttgttactttagttcatcagaaaacttcagcacatgtgtattatacaaatcactatcgctctatctcacaaagagactaaaaaagtgaggacgagagtaagaactcccactaaaagtgaaaattctcaaagggggggaaa

SEQ ID NO: 28 - DNA, 6529 bp, Homo sapiens
  repeat_region (1)..(6529): hervfh21
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttctggtgccgaaacccgggaaggcgatagactctggctgggactcactctctctctctctctctctctctctctctcttcctctccctcccctatcacccctctcccggccaatctcccccttcccgaacctgctaaagacccaaaggatctcctaaattctcccattgttggcgacctcatccaccatcaaagcctccaccagggtgagtgaaaagagactgttgccgttccccagaacccttgaccatccatctctccacttccaaaagacccagcgctgggccaagggcttcctcccgtctctgggcctccaggaggccctcgattcctccatttcagggatgcctgactcggcggttacctcctttattccggacaagttccgtgggaaaggggacgccctctcccaccgtccttgtcatcagcagtctcttcttcccctaccctcccctcctccattcactataggagcctcccaatccactccttccaagaccaccccgctgggtgcctcctccgcaatctcaatgctctcggcctccattcagaaatccgttctaagaggcttatctttttcaacgttctcagatacagacaacttttgccatcgaaatgggaaatggtctgagattccttatgttcaggctttcttcactctccgtaaccgcccttccctctgtcagtcctgttctactttccaaatcctcctcgcccgctccaaacctgactcgcctcctacccccctccccacagccccagctgacgattcctcttcctttgaccctgccaattttccccttccccgaaagcatcacgatcctccaccagagcatcctgatcctccaccgtatgtccccactccagctctacctttctcccctcctctctccaaccaccctgcttctgactctgggtcctctctctctccacccctcaccccctctttggcccaagatgctcagcaaccagctcccttgcttcctcttcaggaagcagcaggagtcgagaggatcgtccgtgtccacgttcccttctccctctctgatctctcccaaattaagaaacgtctcaggtccttttcctccgatcctgacacttatatcaaaaagtttaaataccttacccaatcttacgaactcacttggcatgatctctacattatcctctcttataccctcctcccagaagagaagaaaagatgtggctcgcagctcaggcacatgctgatgatcttcatcggcaagatcctactaagcccgtagaggccgctgcagttacctgggaaaagccttcccgggagtaccaacccacaaaccccagccgagcatctcataaccacatgattacttgcctcattgcaggccttaacaaagctgcccataaggctgtaaactttgaaaadcttaaagaaatctcccaaaggcchgacgaaaatcccgcccaatttcttttccgccttacagaggccttccaaaaatatacccacgttgaccccgcctcccaggaaggaactattgttcttaacactcagtttatctcccaatccactcccaatatttggcgcaagcttcagaagcttgacgacagccctcaaaccccacaacgagaccttcttaatttagccttcaaagtctttaacaatcgtgatgaggaaagaaaggcaaaaacaggcagagtttcaaacgcttgcctttgccatcaggggccctgcaggccacgggacgcagctccacatggaagcctcctagcaattcacttccacctggcgcctgtttcaagtgcggcaatgaaggccactggtccagacaatgccctaacccagataagcccaccaggccgtgcccctctgcggaggacgccactggaagtcagactgtgagtggcccccgcaaggactgcccccatcccttcctgagccggccaaaacctcctactcagatctcatcggccttgccactgaagactgacggtgccctggaacggacgccccggcaactaccatctcttcatccgagccaagggtaaccctgatggtggcaggtaggccagtatattthtttttttcaatactgggacaacctactctgctttacctaatttttcaggacccaccgagtcctcccaggtctctgttgtaggaattgatggacaagtctccaaaccccgagccacccctccactcttctgttccctgcacaatttttccttcactcactctttcttagtcctgccctcatgtccaactccactcctaggcagagacatcctttcaaaattccacactactcatgtcttcctgtccaccgcaaccagagtccctcctgctcctctctgctagtccggcccctgacccctctccccagcacccgctacccacctctctcgttaacccagtagtgtgggacaccaccaccccttccatagctgctcaccaggaccccatcaaaatccagttaaaagacccctctaaatttcccaacattccccaataccccatttccctaacacaccaaaaaggcttacaacccatcataaacaagctctgctcacgccgtcttcttagaccaacacgttctccatataacacctccatcctccccgttaaaaaatctgacggctcataccaactcgttcaggacctccgagccatcaatcaggctgtcctccctattcatcccgtagtccctaacccctatacacttctctctctcatcccctccaacaccacccactacaccgcaattgacctaaaagatgctttctttaccattcccctacaccccgattcccaaaacctctttgctttcacccggaccgaccccgacaccctccagtcacaacaactcacgtggactgtcctccctcaaggcttccaggatagccttcttttcttcgggcaagccctagcccaagaccttgcctccttggatctttcccccagccgccttcttcaatatctagatgacctccttctctgtagcccctccctaaaaaactcccaaactcacactgccacccttctgaatttccttactaataaaggctatagggtctcccctctaaagaacagctttccacctccatggtgacctacttaggaattcaactttcccctggggcccgggctatgaccccagcccgagcggccttaatagataaataatctaccccgccctcttccaaaagcgaaatcctttccttcctagggctagcaggcttctttagaatatggattcccaactttgccctcctagctcaccccctctataaagcggccaaaggccctctcaatgaacccctaaacycctcacataacatactccccagcttccgcgaactccaaaccgctcttgtcactgcaccagctctgtccttacctaatatctcccaacctttcactctctatactgccaaaaaccgaggaatagccctcggtgtcttaggacaacagaaagaaaatcctccttcctttgcccctgtagcctacctctctaaacaactagacaacacagtcaaagggtggccaacctgtcttaaagtactagcagcggcagccagttttagctctagaaagcaggaaactaacattcagccaaaataccaccgtctacagtcctcataatctacaagatctcctctcctcccgagcattaagctcccttcctccttcccggattcaattactccatgccctctttatcaaaaatcccaaattcagtcttgccaaaagtgctcccctcaacccagcatccttactccccgtatcctcttcccttcctactcattcttgcactgacatcctagaccacctgcagccacactttccaaacatttcctccgagcctctcaccaaccccaatgatcaactattcatagatggctcctcttccgggcccactggctcccccaaaattgctggatatgcagttgtttcccttgaccaagtaattgaagctaagcccctacctccaggaacctcctcccaaaaagcagaactcataggctctcaccagagccctaaccctttccaaaggcaaacgagtcaacatttatacagactccaaatatgcctatcacattcttcattcccacgccgccatctggcaaaagagaggattccttactgccaaaggaacccccatcactaacggctccccttatttaccaactccttcaggctgcacacctcccaactaaagcaggagttatacactgttgaggacatcaaacaggttcagaaaggcctttgagggaacagattaatctcaagaggrarcasraargcyrayaaggcagcaragaacagaatctcaggagggatcagaaatgaaatctcaagagggaacagaaaggccgatgaggcagcaaaagaagcctccctttcttctgcccctgcctctctcctcctcattacccctgcaatccaacccaagwactctcccactaagaaaaggcttcactactacaacaaggaacctccttccaaggggactggatagtcaaaaatcaaaagctcgtcctcccccaagagcaaaccaaagaaattctgacatctcttcaccaatccttccatatcggtgcgcgccccctgtacctactcctttgcccttatttctcctcyccccayctattcacctcactaaaagacataacctcaaactgtcatatatgctctgttacttcctcccaaggggccctccrctctccatctattcctacacatcagctaagaggaacactcccaggggaggactggcaaatagacttcacccacatgcctcccgtcaagagaacaaaatttcttcttactcttatagacaccttctctgggtgggtagaagcatttcctacctcttcagaaaaggccgcagaagtctcccaaattcttgtaacagaaatcatccctagatttggtctccctggctccatacaatcagacaatggcccctagcttcatctcccaaatcactcaacaggtttctcagtcccttggcatccagtggcgtctccatatcccatgctggccccagacatccggaaaagtcgaaagggcaaatgggatccttaaggctcagttaaccaaactcactcttgaagtccaaaaaccatggacctcccttttgcccatagcactggagagcattagagccagtccaaaagcaccctccttcctcagtccatttgagttaatatacggacgccctttcctcttacaaaacaggcccccttctaactctcagctaggagaatacctcccaacagtctccctcatgagctatctcctctgccaacaagccgaccagggccctcccaaaaccccacgaaggcccttgacacctcccacctccttaacaaaaattcagggtactgtaatggccgacacctcccctatttatccctcttctcttggctcccctctccatacaccatccttaccctatacccaccacccgggacggtctccttctcccaacatccaacaacactcccacatgcatcttagtggacagaaaacgcttcctcttacactgggaaaaaaaaaaaagaacacaaaaagcctcccagcttaaaccaaacaccctttaacaaccacttctgacagcagccctagctgggaccctaagagtatggatgattgagaataacaaaatagtacatctttttagcatacacaaccagttccgtctaccaagccaaggcatacttttcctatgtgatacctcaacttatattgccctcccctctaactggcgaggcacctcagcaccctgcttttcctcagtccaaaaatcactgttgccccaggagaccagcccctactaatcccagttaatatccctatctgacacgacsatactatacaactcatacctctgttagtaaccctcagaataactacaggagttggaactgggattgtgggattaaccacctccgtttcctattaccaatccctctccaaagacttcacgaatagcttggaagagatagccaaatccattacaactctccaatcacaaataaattcttagcagcagtagttcttcaaaaccgcagaggcttagacctgttcacagcgaaaaaaggagaactctgcctttttctagatgaacagtattgcttttatcttaaccaatctggcgtgatacaggatactgtaaaaagactaaaggaccgagcacaaaaaattaaagaaaacgtcctctgatggccagcgtggccctcctggtcttttagtacctggtttccatggctactgcccctcctaggccctgccgtaaccatttttctctttctagcatttggcccttgtctcttacatctccttacccagtttttacagggccgtgtcagagccttcacccacggaacagtacaagacatgatgctactccaagaataccgacggctccaggaacagcagtccctactgtccagccttcccccccaaccatcgccccttcccagcaagaagcagccagaggacaacggcgcccctcttctattacctattaaaaggctggaa

SEQ ID NO: 29 - DNA, 6996 bp, Homo sapiens
  repeat_region (1)..(6996): hervg25
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tattttggtgcattggccgggaaagaaaggrattcatcggaagggtgagtaggagtggacatttaattctttactttcattttggagkcttgtcctcagtttttttttttttcttctcaagaahcaaacaaaacactgggccyctgtyrgccagttaaaagctdttagdgcggctdccagccttaagactcaggggacaggcttgctggagaggahtttgtcaatcccccatcgcccthaggtgttgggaatgttggctctgttctaatccagtttcctttcacggagggcctagccgtcgcatggggctggaaggaggtcctggggcaactgaaggtttctggttgaggctacacctcagtgttacctgaaggcccctggactaactccagtccccgacagcccatgcagggtgtcggcaccaggacttccagtcttttctattkcattttcttcctttcttttctcgactatcatgtctcctatcccttctttgtatgcaatgttgtgggtgtttttacagcctggggatataatcttgttgagtaaagtcagtcagtgccttagtaatcagaaatgtaactcarwgaattgttgtytttgtgatttccttgaahtgaadaaattchaaatcctbdatctgtagacctwtttctcycccagtrataaacattcatggcactgtatgagrgratatttcaccctgagyaaatayccycctttgcatttaahhtsttttttttcctycatgtgaaarsycagcaytgtccaatgaatctaaacagycyytctatgagacaagttawtttttttstwctgggrcayatrctatrggracagcctatcaarccccaaacstctctttctaacttttgcctgaaaarwatwwagtyrgagtttttacctarcatttcagaccttacaggaccacctagtggratggggttkttctccatrggragccytgtcaaccctttgccccaaacctactgtytcccaattcttttctcttttaagtccctctgtcagtgatcagtccccatrccccatttywagccaagaaaattcaactttcaatagcccggaggaagccatcctgacaagacagattttagccywkakwctatctccatsraaggaargacagctattcaattcttacgttatccttraggcacctgttcttcatcmaactacattgnratttaaacaaaaaaaggattttatatttgaaagtcaactggtcccactctctgggattctratgtttccctggggccatagcaagggaagccaaagatagtgtttaggcactccctccattaaagtctgttgccyaaatccaactacgacataatctctccccggtccctggggtaccttgggagccttttgggctgagtgggtctaggaaaccagcagaatggaaaactaggacctkagacagatgagcacataactwgtcctgccacctacgtcctccagatctatgggtgaagatcatacttgcatccaygggtgaaacctatggtggttaccgagacccagaggwcaaggaagtgaagaggagaagggagatgccctttctctctttctctccaccctaggtcactcagaagggaaaraggagactaagggatgcctttgtctctcctctttttctagataggtaacaaaccatctacagtctacactcctctcaagtgcattctgaaacactggaactcctttgaccctgagactytgaagaaaaagcaacttatattctattrcacaagggcgtggycatcttaccarctrcargacagacgggaggcctggccttctcaggaaagtgttaattctaacactatycaacaactagatsttttctrcagayrggaggrcaaatggtccraggttccctatatacaadctttctttgccctgygagacaacccaratctttrtaagcattgtaaaattaaccctgccctcttgacagccatatcagacaatactacaaaagataattccccaaagtcagagacaaakacaacttctaggtgcctttcctgcyccccttatttgaggcccccatagccatatcatcagctcctccagttttgctacccaagaaacccctacattcactgttacctctacragaaatgcccatcagacakagkactactakggttcaagttcccttctcatcacaggaccttagacaaataaagggrgacctagcaaagttctctgakaaccctgatagatatatraaggctttccaaaatctamyacaagtgtttaatcttacatggagraakngtakackacttctaagccaaaccctaactactamcaagaaacagacraccctacagacaacaagaacattcagagatgaacattcctcctatgaccagtcraaaagagaacccagtcaaarttaaagaggwgaaaaagagacaagatcccaattcccaataggawgagaaacagtgcccctwgataatcctaatgagagccctagtgatcycatagatgratgagtagaaaagaaaaacactttckatgagacatattgaaagactkacaagaacacmgawccagacatcttaattactctaaacygtctatgttaaacaraaatccagataaaaatccctcagcctttatggaagggctgagaaaagctttrataaaacacacctccctkcctatcaattcagtaaagaacagatttattactcrracagcccctaatatcrtaragaagttrcagaaacagaccctgtccaaaaatctctctgrtttttctcaycctcaagttaaaactttacagtatataaatarcrctctcctctgtgccccaactraagatgtctcarrraagrcactgarrctctycttaatttcttarctgaaagrrcatatagggtctcaaaatctaargytcarctctatcaaacttcagtaaaatrcctaggtctagtcttatcagaagggacmagaacaccaggtgagraaaraattaagcccatttcctcytttccctttcccaaaactcttaaacarttgaggggattcttagacattactggattttrcaaattatgggtatstgggwatggtraaatagctaaycytttataccaccttataaaaaaaamctcaagcacctaaaactcactysctaacttgggaacctaaaactmaaaagccyttaaccaaytaaarcaagccttacttaaagcaccarccctcagtcttcccatarggaaggcatttaatctytatgtatcaaaaaggaagtkaatgaccctgggagttttaactaaggctcaaggtccagctcaacaaccagtgggttacctaagcaagaaacttgacttgatggctaraggatggccagcytgcctctgagcagttwyrgtggtggctctgctggtaccaraggccacsaagttaacmmtggggaataactgtytrcayyccacacaaataayaggactgctgtcctctaawggaadtctctggctaacaatcacctcctcaaatatcaaactttgytrctarrrkratctrcagtccrrttraaaacctgcccttgcctraacccagycactttctcccagargaaactaragarcctraacakrattgtraacagstartggtryaaactggtaaaagaaataagaagaatcactgtttatattctctgtaaagttttaattaattaaataaacatttttaaagtgtactcaacttaatgaaaagtgaatatccaagctataagtatattcaaaaagcctttctatttttatctttataaaacttgttttcctggaagaggdttttttctcacttaactgaattacttttatccactctttcttgtcactgttgatgcaagcatagaaggccctaaaataacctctggtggcctaagactcctcaagaaaacaaaaaagccaccacaaattvcattttrraaaaaatctctgctttttttcatrgaaaccctagaattaraaabaaataagtccctctcaaaatcwgcttttktcttctagctatgcttrtttrttaggccctggaaactatattcctagccctgttcttaaaaggcctcaaccagagaccaataatccaattagaaaaytggcaaacaaaaaatcttatagttactgaatyttcttctgtttgtbtagatggttatatacgtgwtktgtgtgatgtctataaaaaacctctaattaattggtgtacaaataagcacttrratcaaahattatttmaaaasaawataaaggctgtagtgcctcttggttcatgtaactttaatatttaavaaataaaaacattcttgtaaaatacaaacgtcttmaaaatgtaaataggtggtctaaattatgcaggtcaaatactaggtttgctaaatgttttaakgttgtaaactgcttctttggcctttaagtactgtcaacctgccagcttcacaattagtaaggcctggtgacatatdaaagtaaccatgcccctaactatactggaagaagtcagactttatctrmwyctagcacataattaaaacaacttaccaggttttacattaaagttaaaattacaaaaagttaccattataacatgtaattgagactactgaaaatggatttgcatgcaabgtgtgtaaaadcagtaaaattttttaataaaaaattataagaaggcataaaaatctacatttttcctaggagtaaaagattgtcttaaattaaataaagtgaaagttttaagcaaatttttgaaatactrtaaaaattaatytttwtttaamctaaattcaaaggaatatcatatggtgttcctttaaattaagcattkaaatgaaagcacaacaaarywytcttaaaatgctaatctrctctdtatcaaaatttctaaaagattataaaagatttgtaaamatcaaactggttaagattaaatararttatcyataarrkttcattaaaattgggrttaacattaatartaractartrcaargrkaaaatttrrctttytctyttwaacagrattttyaygtartartwargrcyaataaaagatwtttgctttttcaaatwtttraktcatkttrrcaaaayaartarcttatrrtaatctaaaaktctattyywtaakatyaamtgttttaramctctaacatattyaasaarskycccaaaatyaaacttcagtytcaagrttrtctttcctrayscmtrrcttttagrgcmcctararcatcaaaagaaagryaaacaarwtattkaayatrtttarrtasrtgggattgymaaaatgatrtyttyttyttcagwttatatttmrrtawataayattrayatatgttccaaaaytrtatrrrrtgtctaagrttctartgtmtamatatrtgctaycaatyawaattaaggttrttatrttrsrwtattrtaaamtcararataaccaaatttytttgtcartcgtgtcaracaattktcttgtttkaatcctcttaaaaatgrtttataatcarctrtrrgactttaayarrtrctmtcaaatrcagrtttctrataacagawaaamrtacrgaactcataaaaarctaaaatrtttayrratatcaarcagaacaaagttaayaraatrraytkarctaatrraaaactraarsaatgyttttaacttttrcttattaaaasttttaacmactragcaarryatactscttaaacawaatttrgamcwtrtytrtttctytttgcctggttcykctaraawtmaraaactadttataaatattyttaacttryarcaatatasytrtttrcatcadtdvaamaaaatccattttcttatgcaatgaaacacaatagaaaaaygctagttcttttacaagrctttaactggaagggtgtgttttcctttaagaaatcaagtttaagttgcaaagccagtaacagcctcttgggaaagctggtctcataccttgtctacacagtcctcatacagaattcctggcctgtggtgagtaaaaaaatgtcactttctaacagactcagaaacactatghtcttgggacctcaaaaatacaggagtttacccaactcacaaatatttaagggtacaaatccatggcttggcccaactttadaaagtcttatctaagatttcttttggaacagadttccatcaaagccttatbaaaaaggcctatggagagatagttactcttgctgcactatgttcaaatartyaggccaagtataataataaagtctattttgcaaacaattcartctatyrtgakttrtttttaacaaaaagaaaactaaaagaaagaaatyatgtttcaaadcttatcatacatttgtcattaaattctaatagttatkttttaagtttttghbtacattttaaactaaccctacttattcctgtgaaccaaccavhgatctcbvactvtaacttaaaaaaacaaaaaggaadggataatataaaaactaaaawmcgtctaattctagacaagtatcctacaaatcckaysrradaatgaaaataaataggatgcccataacccagaggtttatttatttagaaaadcaagaccaaagaaactaacaaagccchaatacacccaaatcttaacagacataattatavtcaccaattatcaggdbatatcaacagcctcaacatttttagdcttgtccttacccccgttgtctcattttaatacatgtcctctaataacccaaattrtttcttttyayctaaaaactatcaaactccaaatgrtaatrcaartgraatgatgcataaacacncctttcytctragracccttaaaccagcctcrrgaraartcctaactgctgttncctacacracacccctytccagcargaagtagccaaaawaatyawcgcycaatctccctaacarcagttggrgtctccactyctgagggaggac

SEQ ID NO: 30 - DNA, 7713 bp, Homo sapiens
  repeat_region (1)..(7713): hervh
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tttggtgccttgactcggattgggggacctcccttgggagatcaatcccctgtcctcctgctctttgctccgtgaaaaggatccacctatgacctctagtcctcagacccaccagcccaaggaacatctcaccaatttcaaatctggtaagcggcctctttttactctcttctccaacctccctcactatcctttaacctctttctcctttcaatcttggcgccacacttcaatctctcccttctcttaatttcaattcctttcattttctggtagagacaaaggagacacatcttatccatggaccccaaactccggcgccagtcactgattagggaagcagcctttccttggtgtttaatcattgcagggatgcctctctgattattcacccaggtttcagaggtgtcagaccacgcagggacatctgccttggtccttcacccttagcggcaagtcccgcttttctgggagaggggcaagtaccccaaccccttctctccatgtctctaccccttctctgcttttctggggcaggggcaagaacccttcaaccccttctccttcacccttagcatcaagtcccgcttttctaggggggcaagaacctccaatcccttatttgcatgccctgacctcttatctctgcaccctaatcccttatttccgtgccccaacctcttatctctgcaccccaatcccttatttctgtgccccaacctcttatctctgcaccccaaccccttatttctgtgccccgacctctttcccgcttttctggagggtaagaacccccaaaacccctccctctgtgtctctactctctcttttctctgggcttgcttccttcactatggacaactttccaccctccattcctccttctcccttagcctgtgttctcaaaaacttaaaacctcttcaactcacacctgacctaaaacctaaatgccttattttcttctgcaatgctgcttaaccccaatacaaactcgacagtagttccaaagagccagaaaatgggactttcaatttttccatcctgcaagatctaaataattcttgtcgtaaaataggcaaatggtctgaggtgtctgacatccaggcattcgtttacatatcactcccttcctagtctctgtgcccaatgcaactcatcccaaatcttccttctttccctcccacctgccctctgagtcccaaccccaagcattgctgagtctttctaatcttccttttctacagacccatctgacctctcccctcctcaccaggctgagctaggtcccaattcttcctcagcctccactcctccaccctataatccttttatcacctcccctcctcacactcagtctggcttacagtttcattccgtgactagccctcccccacctgcccagcaatttcctcttaaaaagttggctggagctaaagacatagtcaaggttaatgctcctttttctttatctgacctctcccaaatcagttagcatttagactctttttcatcaaatacaaaaaacccagcccagttcatggctcattcggcagcaaccctgagacgctttacagccttagaccctaaaaggtcaaaaggccgtcttatcctcaatatacattttattacccaatctgctccaaacattaaataaaactccaaaaattaaattctggccctcaaaccccacaacaggatttaattaacctcaccttcaaggtgtacaataatagaaaaaagttgcaattccttgcctccactgtgagacaaaccccagacacatctccagcacacaagaacttcgaaatgcctcaacctcaggtgccaggggttcctccagaaccttctcccccaggagcttgctacaagtgccagaaatctggccactgggccaaggaatgcccacagaccaggattcctcctaagctgtatcccatctctgtgggaccccactaaaaatcagactgttcaactcacctggcagccacttccagagcccctggaactctagcccaaggctctctgactgaccccttctgagatcttcttggcttagcagctgaagactgacactgccagatcgcctcggaagcctacaggaccatcacagatgctccaggtaactctcacagtagagggtaagtctgtccccttcttaatcaatatggaggctacccactgcacattaccttcttttcaagggcctgtttcctttgcctccataactgttgtgggtattgacggccaggcttctaaacctcttaaaactccccaactctagtaccaacttagacaatactcttttaagcactcctttttagttatccccacttgcccagttcccttatgaggccgagacacttcaactaaattatctgcttccctgactattcctggactacagctacatctcattgctgcccttcttcccaatccaaagcctcctttgcatcttcttgtatcccccaaccttaacccacaagtataagatacctctattccctccttggtgaccaatcatgcaccccttaccatctcattaaaacctaatcactcttacccggctcaatgccaagatcccatcccacagcatgctttaaaaggattaaaacctgttatcactcgcctgctagagcatggccttttaaagcctataaactctccttacaattcccccattttacctgtcctagaaccagacaagccttacaggttcaggatctgtgtcttatcaatgaaattgttttccctatccaccctgtggtgctgaacccatatactctcctatcctcaatacctccctctacaacccattattctgttctagatctcaaacatgctttctttactatccctttacacccttcaacccagcctctcttcgttttcacctggactgaccctgacacccatcagtcccagcagcttacctgggctgtaatgctgcaaggtttcaggggcagcccttattatttcagccaagctctttctcatgatttactttctttccacccctccacttctcaccttattcaatatattggtgatgttcttctttgtagcccctcctttgaatcttctcaacaagacacacttctgctccttcagcatttattctccaaaggatatccccctccaaagctcaaatgtcttctccatccgttacctaccttggcataattcttcataaaaacacacgtgccctccctgctgatagtgtctgactgatctctcaaaccccaaccccttctacaaaacaacaactcttttccatcctaggcatggttggatactttcgtgttaggatacctggttttgccatcctaacaaaaccattatataaactcacaaaaggaaacctagttgaccccatagatcctaaatcgtttccccactcctctttccattccttgaagacagctttagagactgtctccactctagctctccctgactcatcccaacacttttcattacacacagctgaagtgcagggctgtgcagtcagaattcttacacaaggaccgggatcgcatcctgtagcctttttgtccaaacaacttgaccttactgttttaggctggccatcatgtctccatgcagcgtctgctgccaccctaatacttttagaggccctcaaaatcacaaactatgctcaactcattctctacagctctcataatttccaaaatctattttcttcctcacacctgacacatatactttctgctccccggctccttcagatatactcactccatttattctcccacaattaccattattcctggcctggacttcaatccggcctcccacattattctggataccatacctgaccctcatgactgcatctctctgatccacctgacgttcaccccatttccccacatttccttctgccctgtttctcaccctgatcacacttggtttattgatggcagttccaccaggcctaatcgccactcaccagcaaaggcaggatatgctatgaactagttgccttaattcaagccctcactcttgcaaaaggactacgtgtcaatatctatactgattctaaatatgcctttcatattctgcaccaccatgcggtcatatgggctgaaagaggtttcctcactacacaagtgtcctccatcattaatgcctctttaagaaaactctgctcaaggctgctttacttccaaaggaagctggggtcattcactgcaaggggcatcaaaagacttcagatcccattgctctaggcaatgcttatgctgataaggtggctagacaagcagctagctctccaacttttgtccctcatggccagtttttctccttcacatccgtcactcccacctactccacagctgaaacttccacctatcaagctcttcccccgcaaggtaaatggttcttagaccaaggaaaatatctccttccagcctcacaggcccattctattctgtcgtcatttcataaccttttccatgtaggttacaagccactagcctgtctcttaggacctctcatttcctttccatcatggaaatctatcctcaaggagatcacttctcagtgttccatctgctattctgctacccctcagggattgttcaggcctcctccctttcctacacataaagctcggggatttgcccctgcccaggactggcaaattgactttactcacatgcctcgggtcagaaaactaaaatatctcttagtctgggtagacactttcactgggtgggtagaggcctttcccatagagtctgagaaggccaccgcggtcatttcttcccttctgtcagacataattccttggtttggccttcccttctctatacagtctgataacggaccagcctttactagttaaatcacccaagcagtttctcaggctcttggtattcagtggaaccttcatatcccttaacatcctcaatcttcaggaaaggtaaaaccgactaatggtcttttaaagacacacctcaccaagctcagcctccaacttaaaaaggattggacagtacttttacctctcgcccttctcagaattagaacctgtcctcgagatgctacagggtacagtccatttgaacttttatatggacgcactttcttgcttggtcccaacctcatcccagacaccagccctctaggcgactatcttccagtcctccaacaggctaggcaggaaagtcaccaggctgctaatcttctcttgcctactccagatccccagccatatgaagacactctagctggacgatcagttcttgttaagaatctgacccctcaaactctacaacctcgatggactggaccctacttagtcatctatagtaccctgactgccgtccgcctgcaggatcctccccactgggttcaccattccagaataaagctgtgtccattggacagccagcctaatccctcctcttcctcctggaagtcgcaattactctcccctacttcccttaaactcactcgtatttctgaagaacagtaataacccttatgagcctaatacatcccttcattctattaggtctgtttgtccttaccctactttttgcaacagggctttatgaactcacccccaccacttaggctgagcccaaaaaatcttgtcatccctactattttctgtccagtcatactcctattctctgctctcaactacttataaatgccgtactcttgtttacactgctggtttacactgtttcttcaagccatcacagctgatatctcttggtgctatccccaaaccgccactcttaattccctcttagagtgggtagatgatctttgctggcagggcaccctccaatacttccaccctgatgaagttctattctttacttttatactctctcttattctcattcccattcttatgccaccttttgcctctccccagctatctccaccacactatcaaccttacccattctctcctagctgcttctaatccctccttagtgaacaactgctggctttgcatttccctttcttccagtgcctacatagctgtccctgccttacagacagactgggctacatctcctgtctccttacacctctgaacttcctttaacagccctcacctttaccctcctaaggaactcatttactttctagacaggtccagcaagactttcccagacatttcacatcagcaagctgccgccctcctccgcacttatttaaaaaacctttctccttatattaactctactccccccatatttggacctctcacaacacaaactattattcctgttgctgctcctttatgtatctcttggcaaagacccactggaattcccctaggtaatatttcaccttcttgatgttcctttactctttatctccaaagcccaactacacacatcactgaaacaattggagccttccagctccatattacagacaagccctctgtcaatactgacaaactcaaaaacattagcagtaattgttgcttaggaagacacttaccctgtatttcactccatccttggctaccttccccttgctcatcagactctcctcccaggccctcttcttgtttacttatacccagcccccaaaataacagtgaaaggttgctcatagataatcaacgttttctcgtacatcatgaaaattgaacatcctcctctatgcagttaccccatcagtccccattacaacctctgacagctgccgccctagctggatccctaggagtctgggtacaagacacccctttcagcactccttttcacttttttactttacatctccagttttgcctcacacaaggtctcttcttcctctgtggatcctctacctacatgtgtctacctgctaattggacaggcacatgcacactagttttccttacccccaaaattcaatttgccagtgggactgaagagctccctgttcccctcatgacactgacatgacaaaaaagggttattccactaattaccttgatggttggtttaggactttctgcctccactgttgctctcggtactggaatagcagtcatttcaacctctgtcacgaccttccgtagcctgtctaatgacttctctgctagcatcacagatgtgccacaaactttatcagtcctccaggctaaagttgactctttagctgcagttgtcctccaaaaccgctgaggccttgacttactcactgctgaaaaaggaggactgtgtatattcttaaatgaagactgttgtttttacctaaaacaacctggcctggtgtatgacaacataaaaaaactcaaggaaagagaccaaaaacttgccaaccaagcaagtaattatgctgaatccccttgggcactctctaattgcatgtcctgggtcctcccaattcttagtcctttaatacccatttttctccttcttttattcggaccttgtatcttccatttagtttctcaattcatccaaaactgtatccaggccatcaccaatcattttatacgacaaatgtttcttctaacaaccccacaatatcaccccttaccacaagatctcccttcagcttaatctctcccactctaggttcccatgccacccctaataccgcttgaagcagccctgagaaacatcacccattctctctctccataccaccccccaaaaattttcactgccccaacacttcaacactattttatttttcttattaatataagaaggcaggaa

SEQ ID NO: 31 - DNA, 5120 bp, Homo sapiens
  repeat_region (1)..(5120): hervh48i
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tattttggtgctgaaatctgggaggggctcaggtctgcatcccccatggacctagccctccaccccaaagagcaggccacagcagctggacaaaggaaggtcctcagcctccagtcgcctctctgtgcatgcagtcggtcactgatctcgcctactggtaagtttccccagaagcccagttaacagagaaaaatctgcacagcctctcttggtttctccagtccaaagccccaacattggtccaagaaggctctggcatgtgccaggcacccgataattatctagtcttaaggggacgcctctaagccatttaatcctgttccaggaacaaaaaaggcagcagtgatgatggctccttttatcttctccctccggctgtccaggatggcctccttttccctgttctcccaagcccaccctcccttatgggaaactcccggtcctctgttccaaaaaaaaaaacagtcctctaggctgcctcataaaaaaacctgcaaacattaggcctcaagctagatatgtgccctaagcgccttgtctttttttttttttttttttttttttgcaattcagtctggccacaatatgaattaaataatgggtccaaatggcccgcaaatggaacattcaactttgcaattctaacttatttaagcaattaatgctgacgactggagaaatggcaagaaattccttacgtccaggcctttttacactcagatcacaacctgtcctctgcaattcttgcttatctgttcaaatccttcccctccattctagccgccctaatcacctttctcctcccaaccgtacctctttttttctcattaaatccagcagactgctgtccacccctcccagcccctacctcttcctctcaaccatcttctttaaccccccaagcctcctcattgtcttctcagctgccatcttcccagtcagctgtatccacttatttttctacaccgtcccctcctcagaacaattctaatattacctatacctattctcctccccaacgccctctcctgaggcttgtaaacctatcctgccaccttacgcctctgtctatcctccactgcctattaactcaaccgcgctttccccttcaaaccctcagaaggaatcagtattttaaaccttcagttcatctcctaatccacccccaatgtttggctcaagctccagaagcttgacgacggccgtcaaaccccacaacaagtccttcttaatttagccttcaaagtcttcaacaattgtaatgaggaaagtaaaaggcaaaaacaggcagagtttcaaatgcttgcctccaccatcaggggccctgcaggcccacggggccgcagctccacacagaagcctcctaaaaatccacctccacctggcgcctatttcaagtgtggcaatgaaggccactggtccagacaatgcccaaacccaggtaaagccagcagtccatgcccctctctgcggagaaccccactggaagtcggactgtaagcagctcccacaaggactgcccccatcccttcctgagctagccaaaacctcctacttatatctcatcggccttgccactgaagaatgatggtgccctggaacagacaccctggcaactacctttgcctcatccaagccaagggtaaccctgatggtggcaggtaggccagtatatttttaaattaataccaggcaacctactctgctttacctaatttttcaggaaccacccagtcctcccaggtgtctgttgtaggaattaatggacaagtctccaaacctcgagtcccccctccacttttctgctcccttcacaccttttccttcactcactctttcttagtcctgccctcatgcccaactactctcctaggcagaaatatctttccaaaactccacactactttccacttccacattccccatagtacccaacacatcaacccagacccctctggggcttctaactttcttctactcctccaaccacccaccttaaaacgtgcaactttttcttgtcccccatctgtagttaaccccgctgtttaggatacttccacaccctcagtcgcaggacaccacacccctgtccacaatacccttaaatagcccacccagttcctatcacagaagtagtatgccatcccccaagtagctctcataagcctaaagcctatcatttctcgtctcctctccagtcacctactctgcccaacaaactccccttttaacacaccagttctacctgtgaaaaagctagatggagcttatcacttagtctaggacctcaggctcattaaccaagctgtactcccagtatgtccagtagttccttacccatatactttactttccacaattccctccgataccactcatttttctgttctaaacctaaaggatgcttttttttcataattcctttacactctgattcccaaaacctcttttcctttatgtggaatacccccgacacccacctttcatgtgagctcacctggtgcatactacctcaaggtttcagagacagcccccacttttctgtgtccaaaaggcccttgctcatgacctctgtagcttatccctaaagctgtccactctctttcaatgtattaatgatctgctcctgtgtagcccctctcaaaaaaactgcaactaccatactatctctcttttaaacttcttcccaaaatgcgagtattaggtctcccctaaagaaacaaaaatatgcacccccctcagtcacctatctatgcctaactcttaccccatgaacctgagagctcacaaccgaccacatatccctcctccagtccctcctgcctccgcaaactaagcaaaaaaatctctcttttctaggactagtgggatattgtaggctctgggttccctccttcgctctatctgccaaaccattataccaggctgctaaaggccctctctatgtgccattaaactctgcacagcctattacccaacctttccatctactccagaaggctctcacctcagcctcatcctcactctcccagacctcaccaaacctttctccctctatatcgacagatgatgtaaagttgcattatgtattctaacccagtctaagggacctaccgcccaggttgttgcctacctctctaaacagcttaaagccaccattctccgatggcctgcctgccttcaagcattggtggcagctgctgtcctcacccttgaaagcctaaaactatctctccatgccaacctaacagtttattcaacccataacatcaaaaacatgttagctcactgcagtgtactaagtctcatctctgccccatggctcctccaactgtatgctctattcatagaaaaccccctcctaccaatcaccatactaaccagctcccgtctaaacacagccatgctcttacctgaagttacaaccgcccaagaccctacacacttctgtgtaaacactgttcaaaccttccttataccttttccaaacctaacagaacaaccctttccagatgccccctttacttagtttgtagatggcagctccttcctacatcaaggacgctggcatgctggctatgctatagtgtcaccccacacacacacactattgaagccaatctgctcttgctaagcaccacctctaaaaaagctgaactcgtcgctcttcctcaagctctcactctagcagccagacaacaaatcaacatatattcaaattctcgttatacattctacatagtgtactcacactcgtccatctggaaaaaacgaggcttcctaattgcaaaaaacactcctgccataaatggctctctcatcagcaaactccttcaagctgccaggcttctacagaaagttgccatcatttattgcaggggccaccaaaccccggatgatcctatatcagctggaaataggctagcagatcagataaccaaacaagtagccctccaacccatgcaaggccagtttctgtccctgtcctttttctctcctctttactcctcagaagaaaaggaggacttccaagcccaaaaccttcaaaagcaaggaccatggtatgtcaaggaaaggtgctttattcttcctcactctcaaagccttcctcacctccaaagcctccacaaccctttccatatcagttacaacctctcttgcaacttctctgccctattctcacttgccctcacctttccagccatgtttgagaaattacctagtcctgctctgtctgccactcagtgtcaccccaaggctccttccagccaccttttcctacccaccaagcccagggccaggtacccaggcaaaattaacaaatggacttcactcacatgctggccaataaacggctccactatcttctagtctttatctgtactttctccaggtagataaaagcattcccaacaacttcagaaggtataaatgtcatcacacaaactctcttcatgcatataattctccgttttggacttccaacattcatccagtccaacaacggaccctccttcatcagccaaattatccaaggcatctctacatccttaggtataaaatgggttctccacacaccctataggcctcaattctcaggcaaagttgaaaaaattacgtctgtccttaaagcccaactcaccaagctggctctaaaaactcaccagtcgtaaacaaaaaatctccctttcacccttataagactccacacaacaccaaaagcaccctctttttatagtccctttgaaatcatatatggccaaacttttgtcttggggtctccacccttaccagactctgagccactcagatattacctctcctccttaatccagacatggtctttcattcgtgaagcagcaaataaggccatgcctctccctgttaacacctttttgtcctctgaacgtaactgtcttacaggcacagacgtgtttccagacaatccagatgatgcttctgctacagcgacatggtaaataccaacccgtctctcaacaatacccccaaaattaagattttctttttccaagatgtccacgtcaccccctatgtcatgcctgaagtaattattgagtaagtggtcccttttcccttttctctaaccaaatagacaggaa

SEQ ID NO: 32 - DNA, 7785 bp, Homo sapiens
  repeat_region (1)..(7785): hervi
  misc_feature: n is a, c, g, or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aatttggtggcccatacagggaaaacattgtcctccgggaaagggttctttgatcatcctcttgagaggagaacacatcccactgtccttgttgcggtggcctcatgagtaggaatcgagacccacctgtctgatgaataaccccagactctcaacaacgtggggagaaaaagacttgcaacactatggtggccaggtaactctgtgcgcagaccaaggtaagaaatgtcgcaggagtgacaaagtacttccttggtggtcactatattctggtggctgaaagttcatgaatggtaacaagtgctactgctgtgtggagtgaatgagtccaatctgtgggtctatggttacctcatacggcttagccttctctgaaggatcctgatgttggggtttatatagtcctcccaatgctaagcgggacttaaaatattcctaggaggaaagtggccagagtggatgaagcaaaaggagaagagtgtgaagaacctccaggaggtggggctaaaagataggcaagaaatctctaatacgagggattgagccacagaaagctccagacagataaaaaagaaattcctaatatgaggaactgagccacagcaagcctccagcaggcaacaaatccctaatatgagggattgagcctagctaagacccaatatgggaaataccccaagaaagacagagaataagaaggatgaaaatagtaacaaggatataccccttgatagtcccctaggtttcatgttaaaatactggaaagataatgagaggactaagcataagaagaaggagcaaatgataaaatattgctgtttcatttggacccaaggtcccatcctcaaaccctcaatcttctggccaaagtatgggtcgaatgagggtgtaatgagtcaactcctaatccaatatgttaatgataaaagtctggtttctcaagaagaactagactatgctctttgttggaagcagggacctgtcctcctctttcccttaaagacaactagggaagaatccgatccagcatctcaaattgagaagtcagacaagccgactcccacacctaaagtcagcacatgggatcccctagactgtcttcctttgcttactgccccaatcctaacccccctactcctcaggcagctgctgctgccccagatcccatcccagattcttccccaactcatgatgttcctcccgcttacaaccctgactctcaggggcagtcgtcccaagagcctgttcattgccaacctaaatatccttccttaaaagggctccaacatgaaatagagcagtgtaaaaaggacattcagaactccccttttctttccacacctaaggagtcagccataactttcttccctttaaaaggggtatcacaaggaggggaagtcattggttttgtaaatgctctcttgactatttcagaagtctgaggtctgaagaaagaacttaagccactgctagatgacccctatggagtggcagatcaagttgatcaattcttagggacctcagttatacacttgggtcgagcaaatgtctatcctaggctcttcttttcaggggaggaaagaaagcatgatccgtagggctgctatggcaatttgggaacatgaacaccctcctggtcaaaacgttcctactgtggaccaaacatttgctgcccaagcaagactcctggtgggacaacagcaatgcagcccactgagaaaacatgcaggacctaagggaaataataataaaaggaatcagtgaatccatacccagaactcaaaagctctctaaagcatttgatatacaacaggagaaagatgagggacctataagattcctagacagactaaaggagcaaatgaagcaatatacaggtctgaatttagaagatccccttgggcaaaggatgttaaagatccattttgtcactaaaggctggccagatgtttcaaaaaagttacaaaaattggaggactgagaaaaccgacctctaagagaacttctcagagaagctcaaaaggtgtatgtgaggagggacagggaaaaacaaaaacagaagtcaaaaccaatgttatctactttccagcaggtggctccaaacccatatgctactaaatgaggcttccagggagccagaaactataaaaggtcccaagcctcccaaacccagtttagagaaaccaaaccttcagctagaggacccaagtctacatttcccaggccccctaaagagcatagaaaagcaagaccaaaaaatcccaaaactgagagaggggaaggacaagataagtgttacaaatgtggaaggacagcccccttcaaaagagaatgtcccaaattagaaaaggagagagaagcccttccactcacgacctttgaagaggaacagggaagtcaggggctctgtctatattatcttgagtcccaccaggagcccttgataaatttggaggtgggacctacacatgagcttatcacatttttggttgattcaggagcggcctgttcctctgtttgtttcccctcatctaatgttgcctgctcttcagaagaacttatagtctctgagataaaaggggaaggatttacggtgagaatcttagaaaatacagaagtcaagtaccaagactaaacaacccaggttcaatttttgttaatccctgaagcagcaactagtttgttaggaagagacttaatgttaaagttaggcataggcctacaagtcagcccaaagggattccttacttcattaaacttactcaccacggcggatgagaaatacattcatcctgatgtttggtcaagggaagaaaactgaggaaagcttcgaattctcccaatccacatcaagctaaacaccccgcactgggaagtagtgaggaggaagcaattccccattcccttagagggcatgctagggctaaaacctataattgaaagtctcattaatgatgggcttcttgaaccctgtatgtctccttataacaccccaatactgcctgtcaaaaaatcagatgggtcataccggctggtgaaagacctcagagccattaaccaaacagtccagaccactaaccctgttgtccccaacccttacaccattctcagcaaaattccatataatcatcaatggtttactgtaatagatttaaaggatgctttttgggcatgtccctggctgaagagagccgagacacatttgcctttgagtgggaagatccccagttagggtgaaaacaatggtatcaatggacagtcttgcctcaggggttcatggattcacccaacctttttggtcaaattttagaacaagtgctagacaaagtttctgttccaaaacaattatgcctgcttcaatatgtcgatgatattctcatatctggtgaggatatagagaaagaagctggcttctctacacatatttttgaccatctacagttcgaggggttacgggtctcaaagggaaagcttcagtgtatggaacctaaagttaaatatttaggccgcttaataagtgcgggcaagcgaaggatagggcctgaatgggtcgaaggaatcgtgtccttacccttgcctcagactaaacaggaactcaggaaatttttagggttagttggatactgccgcttaaggattaactcacatgccctaaacagtaaacttttataccaaaaacttgcccagggaaaacctgagcatctcctgtggacttctaaagaggtcgatcaggtcaaagagctaaaaggaatagcttataactgctcttgccctagccttaccttccctagaaaatacacttcaccttttcgtcagcgtgaaaaatggggtggctttaggggtgcttatccaagagcacagaggctgctggcagcccatggccttcctgtcaaaaattttggacctggtcacctgtggatggcctcagtgcatccaatccattgcagctacagcagtattagttgaagagagtagaaaattaacctttgggtggagattaacagtaagcacaccccaccaagttagagagctattttaaataaaaaagcaggaaggcgactaactgactccagaatcttaaaatatggggctattctactaaaaaaagatgagagaacacctatgtctagatttaattgactaccaaacaaaactcaggccagatctaggaaagatccctttcaaaacaggacggcacttatttatagatggttcctcccagctgattgagggaaaaagacacaacgggtatccagtaatcgatggagaaattctctatgtataagaacagagtcaagaaaattgcctaataattggtctgcccaaacttgtgaactgtttgcactcagccaagccttaaagcacttgcaaaaccaggaaggaaccatctatactgattctaagtatgcctttggagtggctcatacatttggaaaaagttggactgaatgtggcctcactaatagtaaaggtcatgaccttgttcataaggagttaatcatccaagtactggataaccttcagttgccagaagaaatagctattgtccgtgtacccgggcaccagaaaagcctttcttttgaaagtcgaggaaataacctaacaaaccagatagccaaacaagctgctgtttcctccgaaacacctatgtttcacttaactccttgtcttccttcccctactgcaatttcctttttctcttccattgaaaaagaagaataaagataggagccaaaggagaagaccagaatgaaaacggctgttactagaccaaaaggaaatgttatccaagcccgttatgtggaagatctagtctcaactatatctgaggacacactggggatcccaagccatgtgcgatgcagttctcagggtctatggatgtataagaatttacaccctagccaaacaagttacagatagttgcttaatatgtaaaaagactagtaagcagattctaagaaaaccgccccttggagaaagagattcagggctaagaccatttccaagtgttcaattaattatactgaaatgcccccaattggtcatttaaaatacttattagtaataatagaccactttacctactgggtagagactatcccacactcaaatgcaaccaccagtaacgtagttaaggcattaattgaaaacattgtacccagatttggactaatacaaagcactgattcagacaatggaacccatttcactgcatatgtcattaaaaagttagcccaggtactagacataaaatggaaaaaccatatcccttggcatctctcctcctcaagaagagtagaaaggatgaatcagactctaaaaagccacttaactaaattagttctagaaacttgattgccatggactaaatgtcttcctattgccttgttaagaatccgaactgctcctcagagagatactggcctttccccttatgagatgctctatggattgccctatttatactccactgctaacattcctacattcaaaataaaagatcagttcctcaaaaattatatacttggtccatactctactttctcttcccttaagactaaaggtctcctagcacaggcgccaccgctggagtttccagcacattagcgtcagcctggagaccatgtcctcataaaagggtggaaggaaggcaaactcaaaccagcttgggaaggaccctacttggtgctcctaaatactaagactgcagtccgaacagcagaatgaggatggactgatcacacccgcgtcaaaaaggcgctgccacctccaggatcataaaccgtcactccagggctcaccccaaccaaattaactctaaaaagggcttaataatcacttgtttattttttcttttctttccaacagaaggtcatcttgtcatcaatgtaacttgggctaaccatcctttaatccttcagtttgatgcttgttcagtcatcctgtgtggagacaagcaagctcaaaggaagctgtctcatgtagataagtacctatgtccataccataaaaagtcaaccaagtataagtatagaaccttaaaaagtccctgtggtgactggacagatgtttggaaaccactcagtatggagggtggacagccaggcccccttttcaaataagttatggggactaaaacagaaactccaactaattcatggtcccaccccaccaaactgtaagccactgcagtgtaacccctcattgctaattatagctaacccccaaacaatggcccaagaacccactatattcaaacagtatggattaggagcaaatgttacaaaacaaaatcccataaaaatcttcaaccactggttaacaatgataattaaaaaaaaatccacacccagagtctgggaaacgagtggaatctaacactctctccaagtatagcgagctcagcgtcctcctcccatctccaaaacaacccaactaaagtaacggttgtaaaggtaaaaaatttaaagcagactatagccctagagacaggatgtcaagatgcaaatgcttggctaaaatggattaaatattccatctgcactttaaacaaatatgaatgttatgcttgtgctcacggtagaccagaggcccagattgtcccctttccactcagatggtcttctaactgaccgggcataagctgtatggtagttctcttccaagatcacacagcctggggtgacaaatcatgtcaagctctttctctgctgttccctgaagctcaacaccctgagggtcagcccccgagggcatcagcttccgtttcccaatgccaattttactttgtgtctctcacaacagggagaaaacttggtgttccttggagccttaatgggatgcagtgagcttaagtccttccaagagcttacccatcagtctgcccttagtcatcctcgagcggatgtatggtggtattgtggtggaccattactggacactgccgagtaactggagcagaacatgcactctaattccattggctatccctttcaccctggcatttcatcaaccagaaaagatagaaaccaaacactgtaaaacaagagaggcccctcatgggtctgttgactcccacatttatatagattccactggagtccaacgaggagtgccagatgaatttaaggcccaaaatcagacaactgcaggatttgaatccacgttcttctggtggttaactataaataaaaatgtgaattagataaactacatttattacaaccaantatgatttgttaattatactagagatgctcttaaagggacagctgaacaattaagacccaccagtcaaatggcctgggaaaataaaatagcattagacatgataccagcgaaagaaggtggagattgtgtcattatcggaacccgatgctatacttttatccctaataatactactccaggtgggatcacaccaaaagcactacaaggtcttaccgccttatcaaatgagctagccaaaaattctggactaaacgaccccttcacaaatttaatgggaaattctttggcaaatggaagggatttatgtcctcaatcctcatgtctcttgccatcagaatagggttgcttattcttgtaggatgctgtgtcataccctgtgccctaggattaatacaaaagctcattgaaacagctctccccaaaacctccctcaatcctcctcctcctcgttccagtgagctttttcttttagaagacccaagtagaataacagagccaaattatgttaaaagggtttaagaaaaaatactgtaaaatatttaacagggggat

SEQ ID NO: 33 - DNA, 7243 bp, Homo sapiens
  repeat_region (1)..(7243): hervk
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1992-01-26
tctggtgcccaacgtggaggcttttctctagggtgaaggtacgctcgagcgtaatcattgaggacaagtcgacgagagatcccgagtacatctacagtcagccttacggtaagcttgcgcgctcggaagaagctagggtgataatggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaacttcagatctaaaagattggaaaagaattggtaaggaactaaaacaagcaggtaggaagggtaatatcattccacttacagtatggaatgattgggccattattaaagcagctttagaaccatttcaaacagaagaagatagcatttcagtttctgatgcccctggaagctgtttaatagattgtaatgaaaacacaaggaaaaaatcccagaaagaaaccgaaagtttacattgcgaatatgtagcagagccggtaatggctcagtcaacgcaaaatgttgactataatcaattacaggaggtgatatatcctgaaacgttaaaattagaaggaaaaggtccagaattaatggggccatcagagtctaaaccacgaggcacaagtcctcttccagcaggtcaggtgctcgtaagattacaacctcaaaagcaggttaaagaaaataagacccaaccgcaagtagcctatcaatactgccgctggctgaacttcagtatcggccacccccagaaagtcagtatggatatccaggaatgcccccagcaccacagggcagggcgccataccatcagccgcccactaggagacttaatcctatggcaccacctagtagacagggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatgctaaaagatatgaaagagggagtaaaacagtatggacccaactccccttatatgaggacattattagattccattgcttatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcttgggaaaaaatccaagacccaggaagtacctgcccctcatttaatacagtaagacaaggttcaaaagagccctaccctgattttgtggcaaggctccaagatgttgctcaaaagtcaattgccgatgaaaaagccggtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtccctcaccacaagcggcagtgcagcagtagatttatgtactatacaagcagtctctctgcttccaggggagcccccacaaaaaatccctacaggggtatatggcccactgcctgaggggactgtaggactaatcttgggaagatcaagtctaaatctaaaaggagttcaaattcatactagtgtggttgattcagactataaaggcgaaattcaattggttattagctcttcaattccttggagtgccagtccaagagacaggattgctcaattattactcctgccatatattaagggtggaaatagtgaaataaaaagaataggagggcttgtaagcactgatccaacaggaaaggctgcatattgggcaagtcaggtctcagagaacagacctgtgtgtaaggccattattcaaggaaaacagtttgaagggttggtagacactggagcagatgtctctattattgctttaaatcagtggccaaaaaactggcctaaacaaaaggctgttacaggacttgtcggcataggcacagcctcagaagtgtatcaaagtatggagattttacattgcttagggccagataatcaagaaagtactgttcagccaatgattacttcaattcctcttaatctgtggggtcgagatttattacaacaatggggtgcggaaatcaccatgcccgctccattatatagccccacgagtcaaaaaatcatgaccaagatgggatatataccaggaaagggactagggaaaaatgaagatggcattaaagttccagttgaggctaaaataaatcaagaaagagaaggaatagggtatcctttttaggggcggtcactgtagagcctcctaaacccataccactaacttggaaaacagaaaaaccggtgtgggtaaatcagtggccgctaccaaaacaaaaactggaggctttacatttattagcaaatgaacagttagaaaagggtcacattgagccttcgttctcaccttggaattctcctgtgtttgtaattcagaagaaatcaggcaaatggcatacgttaactgacttaagggctgtaaacgccgtaattcaacccatggggcctctccaacccgggttgccctctccggccatgatcccaaaagattggcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagtgagagaaaagttttcagactgttatattattcattatattgatgatattttatgtgctgcagaaacgaaagataaattaattgactgttatacatttctgcaagcagaggttgccaatgctggactggcaatagcatccgataagatccaaacctctactccttttcattatttagggatgcagatagaaaatagaaaaattaagccacaaaaaatagaaataagaaaagacacattaaaaacactaaatgattttcaaaaattactaggagatattaattggattcggccaactctaggcattcctacttatgccatgtcaaatttgttctctatcttaagaggagactcagacttaaatagtcaaagaatattaaccccagaggcaacaaaagaaattaaattagtggaagaaaaaattcagtcagcgcaaataaatagaatagatcccttagccccactccaacttttgatttttgccactgcacattctccaacaggcatcattattcaaaatactgatcttgtggagtggtcattccttcctcacagtacagttaagacttttacattgtacttggatcaaatagctacattaatcggtcagacaagattacgaataacaaaattatgtggaaatgacccagacaaaatagttgtccctttaaccaaggaacaagttagacaagcctttatcaattctggtgcatggcagattggtcttgctaattttgtgggacttattgataatcattacccaaaaacaaagatcttccagttcttaaaattgactacttggattctacctaaaattaccagacgtgaacctttagaaaatgctctaacagtatttactgatggttccagcaatggaaaagcagcttacacagggccgaaagaacgagtaatcaaaactccatatcaatcggctcaaagagacgagttggttgcagtcattacagtgttacaagattttgaccaacctatcaatattatatcagattctgcatatgtagtacaggctacaagggatgttgagacagctctaattaaatatagcatggatgatcagttaaaccagctattcaatttattacaacaaactgtaagaaaaagaaatttcccattttatattacttatattcgagcacacactaatttaccagggcctttgactaaagcaaatgaacaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcatatgttcatgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggttacccactagacatttgaagttctacaatgaacccatcggagatgcaaagaaaagggcctccacggagatggtaacaccagtcacatggatggataatcctatagaagtatatgttaatgatagtatatgggtacctggccccatagatgatcgctgccctgccaaacctgaggaagaagggatgatgataaatatttccattgggtatcgttatcctcctatttgcctagggagagcaccaggatgtttaatgcctgcagtccaaaattggttggtagaagtacctactgtcagtcccatcagtagattcacttatcacatggtaagcgggatgtcactcaggccacgggtaaattatttacaagacttttcttatcaaagatcattaaaatttagacctaaagggaaaccttgccccaaggaaattcccaaagaatcaaaaaatacagaagttttagtttgggaagaatgtgtggccaatagtgcggtgatattataaaacaatgaatttggaactattatagattgggcacctcgaggtcaattctaccacaattgctcaggacaaactcagtcgtgtccaagtgcacaagtgagtccagctgttgatagcgacttaacagaaagtttagacaaacataagcataaaaaattgcagtctttctacccttgggaatggggagaaaaaggaatctctaccccaagaccaaaaatagtaagtcctgtttctggtcctgaacatccagaattatggaggcttactgtggcctcacaccacattagaatttggtctggaaatcaaactttagaaacaagagattgtaagccattttatactgtcgacctaaattccagtctaacagttcctttacaaagttgcgtaaagcccccttatatgctagttgtaggaaatatagttattaaaccagactcccagactataacctgtgaaaattgtagattgcttacttgcattgattcaacttttaattggcaacaccgtattctgctggtgagagcaagagagggcgtgtggatccctgtgtccatggaccgaccgtgggaggcctcaccatccgtccatattttgactgaagtattaaaaggtgttttaaatagatccaaaagattcatttttactttaattgcagtgattatgggattaattgcagtcacagctacggctgctgtagcaggagttgcattgcactcttctgttcagtcagtaaactttgttaatgattggcaaaagaattctacaagattgtggaattcacaatctagtattgatcaaaaattggcaaatcaaattaatgatcttagacaaactgtcatttggatgggagacagactcatgagcttagaacatcgtttccagttacaatgtgactggaatacgtcagatttttgtattacaccccaaatttataatgagtctgagcatcactgggacatggttagacgccatctacagggaagagaagataatctcactttagacatttccaaattaaaagaacaaattttcgaagcatcaaaagcccatttaaatttggtgccaggaactgaggcaattgcaggagttgctgatggcctcgcaaatcttaaccctgtcacttgggttaagaccattggaagtacatcgattataaatctcatattaatccttgtgtgcctgttttgtctgttgttagtctgcaggtgtacccaacagctccgaagagacagcgaccatcgagaacgggccatgatgacgatggcggttttgtcgaaaagaaaagggggaaa

SEQ ID NO: 34 - DNA, 7953 bp, Homo sapiens
  repeat_region (1)..(7953): hervk11i
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tctggcgcccacgtggtctttcttttttcctaagtgcatgtgggaacccgattccctttggtaggtgcggagaaacgtcatcggttcggtccacagaaacgcttgttcgactccccgacgactggtgagtagtctgtgtatggtccgggttaactatgggtcacgcggagtctaaacattatgcttatctctgctatattaaactcctgttaaaacagggcggggttcgagtgcccatggaaaatatggtcactctattcagggcggtggaaaaatactgtccttggtttcctgaaaaaggaaccttatatgtagaactatgggatcatgttggttcaacattccgggaactggtcccagcaggaaattatgttcccgtcactgtttggggtgattgggccttggtacgtgccgtcctaatgacataccaatcccgtgaccccctgcagttaccacagttttctgaatctggcgatcctccgcctcttcctcagctttcctctcccacacggccttcattatctgctcagcctctcccttcgcctactcctcccccacctaacgatactgaggattcaatgtctaactccggtgactttggcttaacgtcaccccctgatgatcttatttcttttcacgaagagctggtacttgtagctcccgcggccccgactcagacagcccgggaccatatatatgctaattcttccctcttcaaacctttgcagtctttgcctccggagccacctaatggctccaggaccaaactacaatttacctgtaattctgcaggccctcccccatccactgcagcccctcaccctcctgtcgtttcggttcctcaaccggtcactttgccatccactcaacctgcttctctgtacccttcttcacacatggataccagtaatcaccagtacgcttctgcctcttctgctcccccaatgcccctttctcacactctcataccggtccgacctcctcaacctcagtttcccttatctacacatacttttcctgtcacttctatgccgactccgtctcatgtgcctgctcttgaaacttccatgcaatgcttattacgccaaaacaaagaaacaagtggattagaggtgtgggcttatccggtcacgctggaacctcccaatgctcaaggggtacaaatgcgtcgatatgcgccgctcaatcttacctttttaaaagaatttaaggatgcttgtactcagtatggtcctacttctccttatgttaaaatggtattacaaactttttgtactgaggtcattttgcttcctttagactgggaccttttggcaaaagctgttctaactccatctcagcatttacaattccgtacctggtggtcagaggaggcccgtctgcaggctcagctaaatcggactaatggcattctaattactcaggctcagctcacaggctccgatagtttctctgatacttacgcccaattaggctttgatgctcttaccacggaacaagtaacaaaggtgtgtatgagagcttgggataaattacgcgccccaggccaagctcctgtttcttttactactgttaaacagggtcacaatgaattataccctgattttttggctaaattacaagatgctgttgaaaaatctgtctctgatgagcgcgctcaaggtattctccttcgtatgttagcttttgaaaatgcgaaccatgagtgtaaaatggccatgcgttccgtccaacgacaaaatttacctgatcacgaggtgttgcctgcatatattaaagcttgtgaaggcattggatcagagacccacaaagctattctgtgggcacgggccatgaaggacgccaatcaaactggctcgactaattcttttcttggagcctgctataattgtggtcaacttggtcatactcgaaaaaattgcactgttaaaaacttaaaagcggccaagccggctcaacaaacacggccaaatgctcctgctactgtttgcccacgttgtcgtaaaggtaaacattgggcaagtacttgccactctaagtctgatatagatggaaatcccttgccacagaaccagggaaacgggaagcggggccagtcccaggccccaatatcaaatgggacacctcagactcagaccaacgttgcgtttccgcttcaagcggtcccaacgcagcccccagcacaaacaaatttacctacagccaacccagatgggtcccagcctcttcttctgtctcagtacaatgcttgtctacctccacagtagggggcagggcggtcaatctctgtagtaccattcctctaaatttactacctaattctttgcctttaattgtccccacgggggccactggccctttacctcaaggttcggtgggcctggtgttaggcagggcatccacctctgctaaaggtatcatagttcatactggtctcattaattctgattcctctgatgagattaaaattatcgtgtctgccaaggttcctgtttccattccggccggtgagtcaattgctcaattgcttttactacctaatatcgttttaaacaaaggagataagacacgtggccctgggatgggctccggcggtgaaaaggccgcttattggattaatgtaatttctaaacaacggcccacctgcaccatacacattcaaggaaaaaagtttgagggcctagtagatactggggctgatgtttctattatttcctctactttacggccttcctcctggcttaaacatcccgccaacatgggactagtaggtgttggaaaagccgaggaagttcaccaaagcacatttatcttggcttgcactgggcctgatggtcaaaagggaacaattcagccttatatcatgcccatccccattaatcttcggggcagatatttgctggaacaatggggggctgaaattaatattccacataactcttatagtgctcccagtcagcatatgatggaaaacatggggtttgttcctggactcggtctcggtccaaagcatgaagggattactaaacccctcccaattactataaaagaagacagggctggtttaggttatcctttttagtggcggccgctgccacgcctcctgatcctatccctttacaatggaaatctgacacacccgtttggattcagcagtggccgctttctaaagaaaaactggaggctttaactcaattggtttctgaacagttacaacttggaaatgtggaaccttctctttccccctggaattctcctgtgtttctagtaaaaaagaaatcaggcaaatggcggatggtaaccaatttaagggccattaatgctgtaattaaacctatgggggccgtccaacccggcatgcctgcccctgctttaatacctaaaaattggcctctcatagttattgatcttaaagattgtttttttcatattgctttacataaatcggattgtgaaaaatttgcttttactgtaccatctatcaataatcaggagcctgcagctcgttatcaatggaaagtacttcctcagggaatgctaaatagccctacaatctgccagctttatgttggacaagtgctttcaccagttcgagcccaatttccccaggcctatattcttcattatattgatgatattttaattgctgcccccactgataaagaattaattgactgttatcaaattttgagccgctgtgttacagaggctggattacacattgctcaggataaaattcaacagaccactcctgttcaatatttaggaatggtggtcgataaacaacgtattcaacctcaaaaagttcaaattaggagagattctttgaaaactttaaatgacttccaaaaacttttgggtaacattaattatttaagacctactttaggcattccgaaatatgcgctgtctaacttgttttctacgctgcgtggagattccaatctccgcagtctcaggactttgacccctgaggcttcaccggaacgggaattcatggagggaagaatccagactgcccagttatctagagtacagccatttcagccttttcagcttctggtttttgcttcattgcactcccctactgggctaatagttcaacataatgatttagtggagtggtgttttcttcctcattctgtgtcaaaaactttgtctgtttatctggaccaactggccatcttaattggacaagctcggtgtaaaatacttgaaatttccggatttgatccaaatttaattgtagttcctttaaatcggctcaaaattcaagccacctttcaacattccgtactgtggcaaattcacttggctgattttattggcgttattgacaatcattatccaaaaaacaaattgtttaattttataaaaatgacatcttgggtggtccctcgattaaccaaagatcagcccattcctgaggccattacagtgttcactgatggctccagtaatggaaatgctggttatgtgggtcctacagacaagcttatttctaccccttatacctctgctcaaaaggcagagttaattgctgtaattactgccttacaggatttccccaaacctttaaatattgtctcagattccgcttatgttgtacatgccactaaaaatatagaaaccgctactatcaaacatattgataattctgaattggcttctttattttcaaggttacaacaggtggttcgccagcgtagacaacctttctatattgcacatattagatctcataccactttaccgggacccatgtctgccggtaaccataaagtcgactgtttggtctcttttgcaacccaagaagctcaggagttccataatctcactcatgtcaatgctgctggattaaaagataaatttgctcttacctggaaagaggctaagcttattgttcacagctgttctcagtgtcaagtttttgtacttccaaatcaggaacctggcgttaatcccagaggcctaactcctaatgatttatggcaaatggatgtgactcatgttagctcctttggcagactctcatatgtgcatgtttctgtagatactttctcaggttttatctgggctacttgccaaacaggggaaggcatggcccatgttaaaaaacatctgtattcttgctttgcagttatggggcttccacgtcaaatagagacagacaacgcctctggatatgttagtaaggcttttgacttatttatgcaacaatggagaatttcccttattaccagaatcctttatgatcctcatggacagactgtggtggagtgggcaaatggcactttaaaaactcaattggaactacaggtgtgtccaacaaagcataatttaactactccccactcccaattacatttggcattgtttactttaaattttttaaatgttcctaaaaataatactctaactgcagccaaacgccattatacaggcaaaaaattctccctaaacgaaggcaagccagtgttatggaaaaactcccaaaccaatacctgggaacctggaacaattataacgtggggaagaggatatgcttgtgtttcaccaggagatcatcaatcccctgtctgggtgcccactagaagacttaagcttcgtgtgaatactgacaatgaaaaccacagggaaaagacgtccgtgtcagagaccgccctcagacgtggtgagatctgtgccaactcctcagaagctggcacgccaaatcaaaatgggtctgattcaatcctccctgatggcaacggagacccatctaactaatcccacttctcctaattacctttctttttctccttacaaacctaaaaatctcaccatttctattagcctgaaaataacatccctctgttcttctcttcctccttcagcactgaatctcgcttacaataggttttatttaatgattctcctccttatactttctgtctcaccagtttcctctcacactgatttacctgctacacaaaattattcttattgggcttatgtgccttttcctccacttattcgacctctcacctggatggatgctcctgcagaaatctacactaacgatagtgtgtggatgcctggagctacagatgaccattgccctgctcaaccaggagaagaaggcactgcatttaatgttactatgggttataaataccctcctctgtgcctcggacatgcacctggttgtatccatctagaaactcaagtctgggctgcttatcttccggagagatcagctacagagaaatggggacatttggtctccggcctctccctttctcctttaagacaaatgaaagggggagtaataggagataccccatactttcaatataaacctgtaggaaaaccatgccctaaaaattttgagggcccatctaaaactttaatttgggaagattgtgttaactcacatgcagtaatattaaaaaatgactcatatggtttagtaatagactgggcaccaaagggctatttaaaaaacagttgctcctctggcggaaaggaatgcctggaggctacttattttatttcttattgggaggacgaggatcatcatcctactttgcataggaggttcagctcgttctttcccttaaaatgggaagataagggcattaccccccgccacccgaggcctcgtatgatattccccattctgagcccagaacacccagaactttggaaattggctattgccatgtctggactgcgagtatgggaaggggaaacttttctgtctgttgtccccactaccgcccctcacatccgtgattctgaaccccatgataaatcccctttgaacctttttcctctttttgatgccgatcctcctttatgggactccgattggcattacgataattcttatcgacccaggtatgcccctctacctcttcagcatccccaggcacctcggattgcttctttacggtggagaacattgggcattgccaccgccgctcctctccctcagtatcaacgtagattcagacattctgctttgtttacctccaacctgactattcctatacagagttgtgttaagcctccttacatgctgttagtgggaaatatcaaaatttggacgaacaatcaaactgtccaatgcattaattgtcatttatacacttgtattaactcccgttttgactccaggaaaagtgtaatgttggttcgagctcgagaaggaatctggattccggtaactttgcccagaccttgggaatcctccccctcaatacatttaattaatgaagtgttacagcgaattctaaaaagatctaagagatttgttttcactttaatcgctgtgatcatgggcctaattacagtcactgcactggccaccactgccggaatggcattacatcaatctattcaaacggctcattttgttaatgattggcaagccaattccacccaaatgtggaattctcaacaaggcattgatcaaaaattggctaatcaaattaatgatttaagacagtctgttatttggcttggagatcgggtagtgagtctcgaacatcgcatgcaaatgcagtgcgattggaatacttcggatttctgtatcaccccatattcctataacgagactgatcattcatgggaaatggtcaaaggacaccttctgggtagggaagataatttatcattggacataactaaattaaagaaacaaatttttgaagcctctcaagctcacttatccattgtgcctggagctgaggcgttagatcaggtggcagaaaatctttctggactaaaccccacgacttggattaagtctattgggggctccactgtagtaaattttggaattatgtttctctgtttaatcggcttgtttttagtgtgccggaccagtcaaagaatcctgcgtcaaaatcgagagaacgaacaagccttcatcgccatggcacatttatataaaaagaaagggagaga

SEQ ID NO: 35 - DNA, 8116 bp, Homo sapiens
  repeat_region (1)..(8116): hervk13i
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tctggtgcccaacgtgggtttctccctcactgtgtgaagttgcactttgagtgcaggactcagcagaggacttttcaacgacagattcctgaggattgtcgtcattaagcttggtggtaagcttgggcactcagagtatctcagggactccatgggacaagccagtacaaagtacttggcctatttaaacacttcataaaaacccttcttaaagaaggagaaatttcagtttcttctgacaagctaattgaactctttgaggtcgtcattctcatttgcccttggtttccaactgagggaactctagaacttaaaagattgggatgaggtgggccaacagtttaaaatcgctcatagaggggaacatgttatcccgccggccatttgcacagtttggtcctcggttcgctccatcttagaatccttgcagccataggaggagggaatggagggtactctacctttgctctcctccgaagaggttgaggaaatcctcagtactctctctccagagggcactgcacaacctgaagccatcattttagaaatggacctccattctgatattcctttggcatcaccaaatacaccacagcctacctgtcctaccgcacccccagtatcgctttatgaggaccttatgaaggatctccttccccagatctaagaaatccctctgaaatgtactatcagcagcccttgtgccggaacctcctgtactgtctcagccctgctgtagggctctcaaccatccatctgttcagcccggttatgaggctgtcaactctatccctgttcggcccagtaatgaggccctcaatgctatctcttcacccaattctgcctttcctcttatgcatcaggctccacagaagcctaacctgcagtccatgcaccagcctggagttcaggccctgcagtccatgcaccagcctggagctcaggccctgcagtcaatgcaacagcctggagttcaggcccctgaaagatcgcaaagcaggcaactgtgcgtcagcctggcttgaagtctctcaacttctatattcaaaaccccaatttcttttctgcttctggtccagtcacaactgctgttgctacccataagcaataggttacatacattcctgataatgacacccctcttatgagggccattctcagggcaagggaatacggggatcccgaggcatggtgtcctgttattctacaatctcctatacctgctgcccccattctagctgcccctgctctggctgcaatggatcagccaccacctgctgaccaagttcagcaggcagctgacgccactgcctctccagacccgcagctcaggggatcaggctcctcagccagtgcaagaagggcctgatgtcccagcagagccagttcctgaaataccttccattcgggctgtggtgcaacctgatcctttacaccctggtcaggtccacctatgacctgctacttgggaaagtttttctttcaaattccttaaagatttcaaagagtcggttaaacaatattggtaccaattcccctttcgtccgttccgcccgaaaatccttagcagaagataaatgcttggtgccttgtgactgggaaattctagcaaaatctgtcttatctaaatcacaatatttacaatttaggacatggtgggttgatgctgtccaggattgagtccgccttaatcagggctctaatcctcctgttaacgttacaactgaccagttactgggaatggggcagtgggctgcaattagaaagcaaactatattgaatgatgaagtcactaagcaactccgaaaatgctgcctgggtgcttgggataagattcaggatgatggcactagatgtccctcctttacagccattagacaaatgcaaaatgaaccatacccctgacttcattgcccatcttcaggacgtggcagaaaaatctattcctgatctaaataaccaacatttggttgtggaactcatggcttatgaacaagcaaatccagattatcaggctgctattcactctgtaaaaggtaaaatcccaccaggaagtgatttaatcacaacctatattaaagcatgtgagggtgttggtggaacgttacatactgctatggtcacggctcaggctatggccagcattagaatgcttggacaatttcctggtaattttcactgcagccaatctggacataccaggaaaaaatgtcctcggtgttcagaccaccaccctgtacaacaccaatcccaaaaggccgtacaactgcgagtcccaccatccacaccatgcccaagatgccataagggcaatcactggacagctcactgccactcgaaattcgacactaatggcaaccctttacagccacttcaaaaccagggaaatggtaagaggggccagcccaggcccctccagacaatgaggcattccccaactcccagccttgccttgcagccagatgagggcatccccagctcaaccaatcgatccaaccactcagtttccacttcaaccattcatgccacaagcatagatgtcacaaccccaacaaggatctcatttcaatgctcgtcccccgccaccacaggatctgcagcagtagatctctgctgtattagagacatttccctttttgcctggagagccaccaatagctgttccacaggtgcttttggcccttgccacctggctctgttggtttattgctcagtcactcaagcttaaatttaaaaggtgttcaggtacataatggtgtaattgactctgattactctggggaaatacacattactgttagttctgcagttccttgccaagcttcagcaggagattgaattgctcaacttcttcttctgctgtacattccactcagatccagttctcataaaagaactggaggttttaggagtgcagataatcagggtaaagtggcttactgggctaataaaatttctgacacctgacctgtttgttccacgcatatacacagaaagaaattcatgggcatgattgacctgggtgctgatgtttccattattgctttacaccaatggcctcgtcactggcccaaagaagtcacattcaccgggttggtgggagttggtcaggccacagaggtttatgaaagttccactattttacattgtactggcccagaggacgaactggtactgttcaccctctacacctattccagttaatctctggggaagagatcttttacagcaatggggtgcacaaatttcatttccacatgctgccaacagtgagcaaagtaaaaacattatgacaaaaatgagatatgttcaagacactggtctgggaaaattggctccaggtattactgcctattcaacctttctataaatttgactccaaagggcttggttattctttttagaagcagtcactgtcaagcctccagatgccatccctttgacttgaaaactcagccagtttgggtggatcagtggccgctcccaaaaaataagctggaggcgctccataatttagtcctggaacagttagaattgggacacattgaggaatctttctctccatggaattcacttgtctttgttatccaaaagaaatctggggaaaacagagaatgctcactcatcttagggcagttaatgctgtacttcaacctctggggacattacaatctggcttaccctcccgctctatgctcgctgagtattggcctctaatcctcatagatcttaaagattgcttttttaacattccactggcctctcaggactttgaaaagtttgcttttatggtcccttccctcaacaatgtcgctcaggctacatgctactattggaaagtcctaccacaaggcatgcttaatagtcccactatttgtcagtattttgtggggcgtgtgcttcaacctgtcagggatcagtttccccgatgttacatcgttcactacatggatgatctcctctgcacagcccccccatacaccattttgatttcctgcttttctgtgattcaacaagccatttcagaagcaggtttgactattgcaccagaaaaaattcaaactacctctcattttcaatatttgggcatgcagttggaagacaagctgattacaccacaaaaagttcagcttaggagagacgccttaaaaactttaaatgactttcaaaagttacttggggatattaattggatttgcccttctttgggcatccctacatatgctatgtcaaacctttttgccacattatgtggggatccagatttacacagcaaaaggtttcttacagaaacctcagactcagagaggctgagtctgagttatgattgattgaacaaacagttcaatggtctcaggtcactagattcaatcccaaattaccttttactattttaatttttcccactgaacactctccaacagggatcatcacttaggaacatgatataattgaatggtgttttcttccccatagctctctaaggacacttactatttaccttgactaaatttctaccctcattaggcaagcctgttcccatcttttatgacttttgggacaggaatctcaaaaaattattcttcccttaaaccgtcaacaactctgacaagcatttacaaattgtgttatttggcaggtaaatttggcccatttccctggtataattgacaatcattaccctaatgtaaaattgttccagttcctgaaactcacttcctggattttacctaatattaccagaagtattccattaactggagccgttactatatttactgatgcttcctctaatggccgtgctgtatacacaggaccatgggaacgcgttcttaacacaggacctatttctgtacagcgagctgaacttagcactgttatgactgtccttgaggattttcctgagtctgtcaacattgtttctgattctgcatacctcgtgcatgttgcccacaacatagaaacggtgttaaatttttgcctgatgaaagtttactttcactttttcaaaagtcttagacagttctcagaaaacactgtgcccccttttacattactcatatttgagcccatacatcacttccaggacctctttcagctgtaaatgccagagctgatgctttagccacatccatttttatggacatgcgaaattgtcgtgccctaactcatgtcaatgctgcaggactcagaagcaagttccctcccacatggaaacaggcaaaaaccatagtacggcactgtccctctggccaagagttaattttacaaccacttccttcggcagttaatcctacaaccacttccttccagagttaatcctacaccacttccttccggagttaatcctacaaccaattccttcaggagttaatcctacaaccacttccttccagagttaatcctagaggcttttcccccaacacactctggcaaatggacgtgacccactttccagcttttgggagactttctttcatacatgtaacacttgacaccttttcccatttcatctgggttacatgccaaacaggagaaagtactgctcgtgttaaatgacatatgccttcttgtttctcagttatgggctgccctgctaagcttaaaactgataacggtcccagctataccagcattgcctttaaaaagttcactcaagcatggggcattactcacactactggaattccctataattctcaaggacagcctctggtggaatgagctaataaacctctcaaggaccagcttcgcaaacaaggtaacaaaaagaaaggggatgtcagtactccccatgctcagataaatttagctctgttcacattaaaatttttaaatttggccaagaaccaacctttcatggcagcagaacaacactttgctggtaataaatttgacccacaaaaaggcaagcaagtatggtggaaggacacaaaaactaataaatgggaattacgcactgtaattaacatggagtaggggttttgcttgtgtctccccaggaaaggaccaacaacctgtttgggttctctccccatcagctgaatttgtaccatgactccagccctgaagaaccatcagaaacaaaaggagaagagccgccagaaatcaaaacgcaaggctcgtcacctgactaatacaatttatatctcaagtttgcctcacagcctcgccctataactcccaatgctaaaattccaccctgctgatgtgggggggtcagataaaagtaatgtccgaagaggttgagagacacctacaggacaaagggattccaaaaactatgggtaatgttatcttggctgcctttatggtagttactgcagtggtaagtatacccggggctgcagcaactcaaaattacacctactggcatatgtcccgtttccattcttattcgatctgtttcatggatggattcctcagtggaagtttatactaatgacagtgcattcatgccagtccctaatgatgacagatttccggcttaaacagatgaagaaggaatgccttttaatgtgtccattggatataaatttccaccattgtgtgtaggatttgcacctggttgtttggcattctctaatcaaaattggatgtggactgtaccggcctccagcaatgattcttatcaggtgcataatgtcttctgtagtaattcttttcaggttctgaccgttaacataaattcatttgaagaacagagaattcctgtcacagtaaagcataataaaacacaaggattgccagactgtttaaaagaccttataaagggacctaataattcaaaacattctatggagtgattgcaatgccccaaaagtagtagtgctaagaagtccgatcacaagtgttgtcattgactgggccccaaaaggatattattggcgagattgctctggccaaaatacccaatgtcctgagtttaactatttaatagattatgaagagaaaggctggcagtcctacaaaaagagggaatgggtgtctccttacccattcaaatggttggacaaggtcatcgttcctcctagaccaaaaatgattcatcctatagttaccccggaacatcctgaattgtggaggttgtctgcagccatatccggaatcagattatggaatgttgcttatcaaaaaattcttacaaataccaaaacaaacatgtataagatctctttaatgtctgagagggtggtacccattaggagctgtgttaaaccaccatatgttattgattggaaacataattatcacccctgatagtcaaactattgaatgcaataattgcaaattgtttacatgcattgatgctacatttgatccaaaaacaagtgttctcctggtcacggccaggaaaggggtatggatatcagtttctttacaccgcctctgggaatcgtctcttctgttcatgtagtcaataaagtccttaaaggattcttaaaagaactaggagattcatttttactctcattgcggtgattgcaggtttaattgctgttactacaacagcggctactgctggagtagccattcataacttggtccacaccactcattatgtggaaacatgccaaaaaaattccacctgactttggaattctcaggctcagactgatcaaaaactggccaatcaaattaatgatctccaccagagtgtcatctggttgggagacaggatgatgaatttagaacactgaatgcaactacaatgtgattggaatacttctgattattgcataacaccttatggttacaaggaagatcaacatagttgggaaaaagtccaaaggcatctaaaagcctgggatgataatttaaccctagacatttcaacactgaaggagcacatttttgaggcttcccaggctcacttaactaccattcctggttctgatatatttgaaagaattacaaaaggactatctgatctaaatcctttcaagtggatcaaacccgttggaggttcacttttgttatcagcattactaatattggtgtgtttatgttgtttgcttttagtctgcaggcgtctccacggagtccaatgaaaaactcgaagccagcgacaagcaatgatggcaatgataatcctaatcaataaaaaggggggaga

SEQ ID NO: 36 - DNA, 5945 bp, Homo sapiens
  repeat_region (1)..(5945): hervk14i
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttcctggctgcccaacgtggggcgacaaagaccccagtgaaggaacgctagagcatgtgaaagcagaggacgcatcgtcaaaggacacccgaggacgtctaaaagaagctcggtgggaaagctgagcgctcggaagaaccagggtaacaatgggacaaagtgaaagcagacattctgcttatttaaatttcttaaggcatttattacgaagagggggagtgaaagttagtactcagaatttgttatcactctttagtgcagtaaagcagttttgcccatggttcccggaacaagggactatggagttggatgaatgggagagaattggcagagattttaaaaaggcgtataaagatggagcaaaaattccagtctcggtttggtcaatgtgggtgctaataaaagcagctcttgagccatttcaaacagatgatgaggcagattcagatgaggaagaggaggacgagtgtaaaaaactaacttcagattctgaatgtgaggaacaggaaacggaggaaattaaagaaaagaaagggaaactgaaaaaagtatgttttactagcccgtcggctccacctgctgaattaagtgaatggccacctcctctctctccccttaatgggcgagaaaatgaattagctacaaaacttactgctcctgtagttgcaacattaaaacctggagcaattggtggtgctatacaaaattctattcaaaaggctagagccgagggagaccttgaagcatggcaatttcccgttactataatccagcagggaggacagaatatagctaattgggccacttttccttttaaattgttaaaggaattcaagcaagccattagtcaatatgggccgaactctccttttgtgcaaactttattaaaaaatatggctcttgataatagattaataccatatgattgggatactttgacaaaatctgttctcactccatctcagtacttgcagtttaaaacctggtgggctgatgaagctcaaactcaggcaagggaaaacacacaagcacagccacctgtgcctgtttcctttgaacagttaatgggagttggccctaattggggtcgattagaaaatcaagcagtaatggaggatgttgccattgttcagctgtgctctgtgtgcttacgggcatgggaaaggataaatgttacaggggaaaaatacccttctttcagttctgtccgacaaggacctaaagaaccatatattgattttattgcttggctccaagaggctgtgtataaagccataactgataaaacagctcaggatgttgtaatacagcttcttgcatacgataatgctaatgcagagtgtcaaactgctattagacccctgagagggaaggctcatttagctgaatatattaaggcttgcgatggcattggaggtaacttacataaggctactcttttagctcaggctatggctggattaagagtaggaaagaatatgccccatttctcaggctcttgcttcaattgtgggcaatttggacacacaagaaaggaatgtagaaaaggaaatcaaaaggcaagaactactaccatcaatcaacagaaaagtcccggtgtatgtccccggtgtaagaaaggcaatcactgggcaagtcagtgtcattctaaatttagcaaagatggacaacctctttcgggaaacaggaagaggggcccgcctcgagcccctcaacaaaccgaggcatatccggcacagccagtgcccttacaaatgtacaacaattgtcccccgcctcagcaggcagtgctgccatagacctctgcagcacaattcccgtctccttacttcctggggagccaccaaagaaggtccccacgggagttaggggacccttaccctcaggaacagttggtctattacttggaaggtctagtctaaatttaaaaggtgttactgtgcatacgggaataattgactctgattataccggagaaattcaattagttattagttcctcgactccgtggtctgcctccccaggagaaagaattgctcagttgttgctgttaccttacataaaactaggaagcagcacagtgaaaagaacaggaggctttggtagtactaatccagcaggaaaggctgtgtattgggttaatcaagtgtctgacaaaagacctatttgcacagtaactattcagggaaaagattttgaaggactagtagatactggagctgatgtctctattattgctataaatcaatggccccggcactggcctaagcaaaaggcatccattggtattgttggagtaggagctgcctcagaagtttttcaaagttccttgattttaccatgtcaagggccggatggtcaggaagggacaattcagcctatcattacacctattcctgtcaatttatggggtagagacttattgcaacaatgggatgctgaaatatctattcctatggatcaatatagtaataatagtagacaaatgatgaaaaatatgggatattgcctgggaaaaggactaggaaaagataaaaatggccaatcagaacctttagaattaaaagggcaaacagatcggacccgattggggtgtcatttttaggagcggccattgttgagcctccggctcccattcctcttgtttggctaactgccaaaccggtttgggtggagcaatggccactgaaacaggaaaaactggaggctttaaaagaactggtgcaggaacaattgcaaaagggacatacagagcctactttctccccttggaattctcctgtatttgtcattaagaaaaaatcagggaaatggagaatgttaacagatttaagggctgttaatgctgtgattcaacccatgggtgcactacaaccagggctgccctccccaacaatgatcccaaaatactggcctctcatagtaatagatctaaaggattgctttttttaccattcctttagctgcccaagattatgaaaaatttgcttttactgttcccgccataaataataaagaaccagcggacagataccattggaaagtactgccacaaggcatgctaaatagcccgactatttgtcaaacttatgtcgggaaagctattaagccagttagagaacagtttaaaaaatgttatattatccattacatggatgatattttgtgtgcagctgaaactagggaagaattgatgttgtgctacaaacagttagaaaaggctgtaaatgcggcagggttaattatagcccccgataaaatccaaacttctactccctttcaatatctaggaatgaaggtagagcaaagtgctattaagcctcaaaaggttcaaattcgaagagataatttaaaaaccttaaatgattttcaaaaattattaggagacattaattggattcatccaactttaggcattcctacctatgctatgtctcacctcttttctactttatgaggtgattctaaccttaacagtaaacgctccctgtccaaagaagcattggaggaacttcaattaattgaggaaaaaattcagcaagcacaagtagaacgaattaatctgatacagccattacagtttttagtttttcctactaagcattcgcctacaggagttatagttcaacaggatgatctggttgagtggctttttctacctcacaatacaaccaaaatgctcactctgtacttagatcaaattgctgtgctagtaggacaagcgaggctgcgcacaacaaagctaatgggatatgatccaaatcagattatagttccattaactaaacaacaaattcaacaagcctatattaattcccaagaatggcaagttaatttggccggttttgttggcattcttgataatcattatcctaagtctaaaatcttccagtttctaaaattaacatcctggatattgccttctattactcaaaaagcccctattgaaggggccattactgtttttactgatggatctagtaatggaaaagcctcatttgcaggacctcaacaacaagttttgcaaactgactttgcttctgctcaaagggctgaacttatggctgtgataacagtgttaaaaacttttaaacagccagtaaacattgtttccgattcagcctatgtagtgcaagccacgcaaaatattgaatgtgccttaattcaaaatgtgactgatgaacaacttaatcttttatttcattctttacagcaagcggtacaacaaaggcattcacctttctatatcactcatatgagagcacatactaacctccctggccctttaactaaacttaatcaaagggcggatgcattggtgtctgcagtctttgctgatgcacaaacatttcattctttaacccatcttaatgccgcaggccttagaaaaagatatggtctatcatggaaacaagctaaagaaattgtgcaacactgttctgcctgccaagtcctgcatctgccacatcaaggaacaggagttaaccctagaggtttatctccaaattccatctggcagatggatgtaacacatattcctgcttttggaaaattgtcctttgttcatgtttcagtagatacctattcacattttatctgggccacatgtcaaacaggggaggctacagctcatgttaaaagacatcttttatcttgcttttctgttatgggaatcccagaaaaaatcaaaactgataacggcccaggatactgtagtaaagccatggctacattttttcaacaatggaatattacccatactacgggtattccatataactcacaaggacaggcaatagtggaaagagctaatcgtactttaaaaactcaaatacaaaagcaaaagggaggagaccaggaatataagacaccgcatatgcaattgcatctagctttattaacattaaattttttaaatttacaaaaagatcaacccatgactgcagctgaacaacacctgacaggacaaaaggaaaataaaaaggctggacaagatatatggtggagggatgcacatacaaagagctgggaaaaaggaaagataattttatggggaagaggatttgcttgtgtctctccaggtgacaatcaggtgcctgtgtgggtgcccaccaaacatctgaagatctatcatgagccacagcatctagtggacccacctgtacagtgcaaattgaaggtttgaggattgcttttaagcctcgatttgctttctctgtgccttctgttagaaggggcctgtttctcattatcagtggtaagttttaccccgtggtaattaaccaaagaggcagaagctgagttacaaatgcttcagcaatggcatgcctcccggctacagccacaaaagtttttgcttctgtttcagtagatttactaacgtgggggtgagggtatgcttgtgtttttgcaggagatgaacaaaccatgtgggtgccctcaagatgtgtacgaccatggaatgggagactggagggacccatggatcccaaccatggactgggttcccccagtacgagccatgagccagttgaatctgaatgcgaagatggaacgaggaccgaccagagtcttaccgatgcttaacggaccaatgctttctgactgagctcctctctaccctgaatacaagagaccctaatagttaggcaggagtatcatcgcccctattcagcatgaagaagttacagaagatggaccttcatccttctgcaacccctaggattaagggtcctcttgtaaaagggaaaggggagatatgtgggaagcattcaaaccagagcgactccatttttaataagggctaagaaaaatgaagctggatcaccaaccggcaattaagggctgcacagcctgcaattgccttgctcaattaatttaaaaagaggccaccttatgctagtaataatgatagcttctcttttacaaaaaagagaaggggggca

SEQ ID NO: 37 - DNA, 6837 bp, Homo sapiens
  repeat_region (1)..(6837): hervk22i
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ggtggtgccccgcgtgaggaacgctgcaaacggatcgtgacggacccctcgaaaatgaaggtgaaaagaactgcgcagtcagtgagtaatcagtaagtcattggtgcccgctcgggatttccaagttcggggggaattgttcaggctagggtttcatcatgggacaacagttatcagctcaacagaaacagtatataaaagtattgaaacagctgcttaaagctagcggagcctcagtttcgcaggctcaattaagggacctaatgcaaactgttgtttcccataacccatggttcccggaagaaggtacgctagacgtagagctctgggaacaagtggggagaaatcttaaacaacatcatgcacaagggcaacgggtcccagtaacatctttaacgttatgggccttagttagggcggctttggtcccgttatacacagaagagcctaaaaagggaagggaggaggaaccgtcacctaccttaccacctcctcgtccctcagccccgctatcaccgggccaaaataacaaagaggaaacggaggttttgcctgagccccctcctccaatagattggaaaaaagacaggggatacgctacagctatgggaccctgtcttaagcaagcggcattagaaggggagctcttagcctgcccggtaatgcaagatcgacaaggcaatcaggtgtatgaacccatttcttttaacgcttataaagagctaagaaaaagcattaaagaaaacggagccgctagcccatttatgaaaggaatgattgaagccatggcagacaacttctgtatgaccccatgggactggtcagtgctagctaaaacaactttggagcccagccaatacctcctctggaaggcagaatatgatgagttgtgtgaacaacaagccaaccagaatcaggtggccaggcaagacataacagctgctatgctccaggggaggggtccccatgccgatgtacaacaactagattttgatccccaggcctatgcacaagtgtctttgtgtgctctcagggcttgggaccgaattcccgaaagcggagttcaacagggatcttttataaatgttcaacaagggcctcaggagccatttgttgaatttatcaatcagttaacccaggcaattaagagacaaattagtcacgcccaggccgctgatatcttattgttgcaattggcttatgaaaatgctaatgtcgatcgccagcaagcaatgcaggcaatcagaggaaaggcagccacagtcggggaacttatacgagcatgtcaactggtggggactgaaacacacaaagccaaaatattggctatggcattaaggcctcctaaagtgaaaagggagagaaacccaaattgttttctatgtggagagccaggtcatatgaagagggaatgccccaataatagagaccaaggtaactcaggaaaagaacccccttctatatgcccccaatgtaaaaaggrgaaacattgggcaaatcaatgcaggtccaaatttgayaaaaacagmaaccccataagtaaccaggcgggaaacttcatgakgggctggccyyaggccccgctwmaarctggggcaatgccagcagctttcctcggtcagatggaaagcccacagtcctctctctcagagcagccaccactgggagcgcaggactggacttactctgccccaacaaattagtgctaaaagaaggagaagaccctaaaagggttgcaaccgggatctggggcccactgcctccgggaacagtgggattagtcctagggcgatcaagcctatccagtaaaggaattaatgtgctcactggggtaattgatagtgattatcaaggtgagatattagttatgatggaatgtaaaggtctgcatattcttccccctggatcaaagatagctcagttactgctyttaccatactgggtccccaacgcccacggaaaggaaaggggaaagggaagttttggaagcacgggagccacaggagtatatgggaaycaattaatcactgatcagagacccatgattaccttaaaaattggaaataaaaattttactggcttattggacacaggggtggatatttcaatcattagtgatcaaaactggccagaaacttggccttgggtcactcagaaacaaaaaattgtcagcatcggggaagcgcacacagccaagcagagcacgcgccccctaacatgttgcgattcggagggaagaaaggcagttatacaacctctaatcatgcccatccctgttaatctttggggacgggacctattagcccaatgtggggggtcactctgcagacccctttctaataatggccactgttattattcctcccctacccctgacgtggctctctcaagatccaatttgggtagaacagtggcctttaaagggagagaaattacaaagagcccatgaattagttgaagagcaattaaaagccgggcatatagaaccatcaaacagtccttggaattcgcccattttcatcattcccaaaaagtctggtaaatggagacttttgcatgacttacgtgctattaatgctaatttgcaacctatggggccccttcaacaggggctcccttcccccgcggcgattcctcaagattggcctataatcgttattgacttaaaagactgcttttatactattccccttgcagaacaggacagagaaaaatttgcgtttacaataccagctatcaataatgaaaggccagcttgctgatttcattggaaagtgcttcctcaaggaatgctaaacagtcctaccatgtgtcagtatcatgtaaatcaagctttgctccccagtagaaaagaatttcctaattgcaagattattcattttatggatgatattttacyagcagccccaacggagccagtacttttaartttatatacctctgtcgtaaagaatacacagytaagaggtttaatcatagcacctgaaaaagtacaaatgtcctctccttggaaatatcttgggtacatactaacttcccggtcagtaagacctcaaaaggttaaattaaatactagcaacttacacaccttaaatgattatcagaaattactaggcgatattaactggctttgccccaccttgggcataactacttataagttgcaaaacctgttttctatcttaaagggcaatacagccctagactctcccaggtatttaactcctgcagcaaaaagggaaattgaggaaatagagcaagctatttctcagaggcaactagatcgcatagacccatgatattcagttcagttgtttgtttttcccactaaacattccccaacaggattaataggacagatggccccagggctgcgctttctagaatggatttttttgctcacataccgggactaaaacactctctccctatatccagctaattagtaaagtcatctattcaggccacagacgatgcaatcagttgctaggttatgaccctgatatcatcagaattcctttaagtaaaaagcaattcgaagcagtattgcccttatctttagatctgcaaatagcactctctgattacgcaggccatatagagcatgcccttcctgctgacaaactacttcagttcttatctcatactcctgtggttttgcctacaaaaatagttcactcccccatacctaacgctttaacactgtttactgatggctctggtaaacatggaaaagcggctatttggtggagaccacataattccctcactcattctggatttactagcactcagagagctgaggttggagccttaatattggccctggagactttttctgctcagcccatcaatattgttagtgactctgcttactctgtttatttattgcagaaccttgaaacagccctcattaagtccactctggagcccaccctgtgtgcactttttctttgacttcagcaattgctggatcaacgtacacatcctatttttatcacacatattcgagcccacagctcactgcctggcccactggcttatggcaatgatcaagcagacctgcaggttatgacgtcactgcttgaccaagccacccaatcgcatcaatttttccaccaaaattggagaaacttatctaaacaatttcaacttacccaragactagctaaacaaattatcctgcaatgcccagattgccagctcacaggcacgtcccctccttcaacaggtgttaaccctagaggactagaacctaatcagttatggcaaacagatgttacacacgtccctgaatttggaaaactaagatatgtacatgtatccattgataccaattctcatctaattagcgcacatgctcttcctggagagtccacccgatatgtcattaaacatcttcttttaacttttgcatttatggggcggcccacaaaaattaaaactgataatggtctggcttatgccagctcacaatttcaacaattttgtcacacatggaacatccaacattccacaggcatcccgtataacccccaaggacaggccatagtagaacgtgcccattccacccttaaaaatatgctcagaaaacaaaaaagggggaatatgagtaaggaccctgcaacactattggcacaagccttatttacccttaattttttaaatttaaatgataaatttcaatcagctatagaaaagcactttgctaaaacctctcaagacataaaacctgcagttttatggaaagatgtaaacagtaatgtatggtgtggtccaaatgaattgttaacatggggaagaggatatgcttgtgttcacaccccctcaggtcctctttggattccagcacgacgcatcaaaccataccatggcatggctaggacccaacccagtaccagaaatgaagaaaatgaccctgcaggacccacagccccggacgatgcagcttcctcggatgacacaagccccggacattacctgggggatgctgaagaagacaactcaggaggccgagcgaatcctgctccagacacagacaccattcactccagataatttgttccttgctatgctctctgttgtacattgcaactcatgtagggcattgatcctttttatgctctcgctttgtctgcaacctgtacctgctacactctattgggctcatctcttagatccgcctttcttccgccctgttacctgggcagacactcccttcccagcctctaataacgtaactgcttggctaggagggatagatttacccccagtggggtccctcagtaatggcacacattggactaaggtgccaggtaacactacatatcactccactatcctcccactgtgtgtaagttataaaggttctaacccttactgtgtacctgcccaaacacaattatggctacatcatggcaaaggaaatgcctttacagtcttagctgcaggtagcctcaaaccaggcaatgcaatcaatgccactttcccaaacattccttcctgtgctaaagaacaaagctgggaaagtaatggattccactttagctgggaggtctgtcacgggggacaagcccgtagcctccagttaggcaattataacatcttagactggagtccccacggccatttgcagggcaatcttactgatgtcctcatctatcatggcatcaatcacagtttcgtagccacgtcccgttcccctatratttgggccgatggggggatgggatatcccagaccccaagtaaagtccatgccaccccaagacactttatggtgcctgggacatcttagcacctcccttaacacctggcatgggacatatcataattccagtcacaattatactatgacctttattcataatcacactgatcagtgcctgatttgcactacccatccatatgttttccttatgggaaccgatatttccgttacaccccaaaactccacgtttgtgacccgggtgcagggacaggcttggttcgcctcatgtatcactaattataatatatctaatttaaatattactagtgtcatggtattgaggagacaatctgaggctttcctaccagtcaatttaacatgcgattggcaaggttcctctgcccttgccaccttagaatgtgccctgtcccaggtcagacgcaaaagattcatagttacacttacagcctttatagtctcagccatagtcatcctagcaactgctagtgttgctgtagcatctattactgaatcagtacaaacagctacttttgtagataatttggccagaaatgtgtctaatgaacttctcttacagcagggtayagatcaaaagattcttgcacgtctgcaagccctcgaggctgccttggaatatgtaggggagcgacaagatgcactggcattccaacagcaattaaactgtgactgggagcataagcacatctgtgtcacctctctaccttggaatcaatcaatacatagttgggatgaggtgaaacaacacctctggggaacctttcatgacaatttaacagcagacgtaaagcaacttaaaactaaaattctagaatccctaaacgccatagatctacacgcccaacaaacagccatatggaagggtgtgcgagatcatctctcctggatagacccccgctcctgggggtcactccttgattggaaaagaatgttgctaattatactcatgtttgtcttatgttatttactaattctaggatgcaaagccggaatacgagctataaccgccgcgcctgacagacctgttgctgcacacatctgtactcttcaatcaacaaaacctgatgcaaaaaacagaaaagggggaga

SEQ ID NO: 38 - DNA, 7242 bp, Homo sapiens
  repeat_region (1)..(7242): hervk3i
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tagtggcgccccgaacagcgacagaatcaggcgctcaacaagtggcatccgaacacagggactttgaggacgtgaacgaagaaggtctgctggagcagagaaactgaaattgacaagacgaatggggaccctgggatgagtctgctggcagcagatataaggtcagtgccctaacgaggtactgggagcaatataaggtcagtgccttaaagaagtactgggaatgggagtttttctgaatcggaggtaacatggggcagaatttgtctgttgaggaaaaacattatcgtgcagttgcttaaagttttgttgaaacaatctggtgctcaggttaattctcagacattaactaagatgctgcaggaggttattacgcataacccatggtttccacaggcaggcactcctgatgtagaaaattggcacagagcaggagaaggattaaaacaggctcatcaaaaaggtcttaaagttgattcttctgctttctccactaggagtttagttcatactgtccttctgccattatatcctttttattctgctggacagcaggagtcatgttctgagtctaaaaatctgaaagaatctgttgtcccacccacagcaccaattgaaaataaaaaacaggagagggaggataaaaattggcctataccgccccctccagttgcagaaacatctgtaccgcctccttcagtagccgaaatagagacctcaatacaaagaattttatgctctgctgccatagctggagagcccttaggacctctgcacttttcctatttccgtaaggcctgatccaaacaatccacagcagtttattcatgaacactccccactagagtttacgttgttgaaggaattaaaaattaagtgtaattaataatgggatacagagcccattcaccttaggattgctagaatctgtatttggtgctatgcgccttctaccctttgatgtaaaacatttggctcgcacttgtttgtctgctactgcatacctgacttggaatttaaattggcaagaaatgtgtgcagaccaggctagacagaatcatgcttctggacacggagacattacagagggtatgctgttaggtaatggccctttattcagacctggcatgtcaaatggcactcccagatcctgcttatcagcagtgtgcacaggctgctatgcacgcctgggccacaattccagaagagagagtcccagtacaatcctttttacatctcatgcaagggtcacaggaaccctacgtgcaatttcttgcaagattacaagaggcagtgaagcatgaaattcctcataccgctggcacagaaatgctaaccttaactttagcttttgagaatgcaaacgcagattgtaaacgtgcactggcacctgtgaggtgtaacaaaacttgggaaattttctcagaacttgtcaggatgtagaaactgagcttcattgctctgcaattttagctcaagcaatggctaatttagtagttgacaaatctaaaaggagccgacggtcaaaccctaaagtgggaaaatgttataattgtggaaaaactggacattttaaaaaggaatcatgactgatctcagggcagaaaggaccttataatgtggtgccctccacccccatggcccagcggaaaaaaacgccaggactctgtcctcactgtaacaaaggaaatcactgggctattcaatgccgctcaaaatttcatcaaaactgcaaccacctgtcaggaaacgagaagggggcctggacccgggcccctcaaacaatgagggcattcccagttcagaccacaaccccacttcaggggtgggtcccaggaggaacattgattccctcaccccaggaacaccaggaagtgcaggattagatcttccagtcagagaaagaattacattaattggtggagacaaacctatcaaagttcccattggcatttggggacctttaccagcaggatacagtagactaattttaggcaaaagctgccttaacttgcaaggcattactgtagtcccaggagtagctgactctgattatgaaggagaaattcaagtagttttaatgtcacaagatctttgggtttttgaaccggaagaatatattgctcaattattgcttattccctgcaaattacacccttctccataaaaggagaaacgaggaaataaagggtttgggagcacaactacatgagaaatctaatgattcacaacctatagcttataatagacccacctgtgtagtacaaagtaaaggaaagaaattgtatgggcttatggacacaggagctgatgtgtcagtaatatccagtaaggactggcccccagcatggcctctcagactaacctccacatccctagtgggagtaggagcagctaaaagtgttcaacagagtgctgagattttaccttgtcttggtccggatggacaatcatgtactttccagccttatgatgcaaatatagctatcaatttatggggtcaagaattacttacagcatgggatatgagacttacaaatgaaaactttcataacccaggatttaaaatgttgaaggacatgggatatcagagtggaaaaggtttagggaaattcctacaaggaaaccctaacccgatatctataactggagaaacagatagaaaagggcaaggatgtcaggatttctgatggggatcattgatatttctcctcgacccactgccttaccattagaatggctttgtgacaaacctatgtgggtggatcaatggcccctaacacaggagaagctagatcaacttcatctgttggtaaaagaacaattgaatgcaggacatatagagaagagtttcagcccctggaattcaccggtatttgttattccaaaaaagtctggaagatggtgactactacatgatttgagagttattaatgcgcaaattaaaccaatgggtgccttacagcaaggtctaccttccccagcagccattccaagagacaggcctcttgtagtaatagatcttaaggattgtttctttactataccataacacgagaaggataagcctcaatttgccttctctgtgtcttctattaatcatagagaacctgtctctcgctatcagtggaaagttttaccccaaggcatgcttaacagtcctacattatgtcagcattttgtaggaagagcattaaaggagccttgaaatatgtttcccactgtctatatcattcattttatggatgatattcttttggccgctcctacagatcaaattttacatcagttattcagagaaacaaaacaggccttaactaaatggaatctcaaaattgctccagagaaggtgcaaacaacttccccataccagtacttaggaactattgttatggaggggagtgtacggcctcagaaagtagttctccgtaagggcaggttacagactttgaatgatttccaacaattattaggggatattaattggctgtgcccaatgctaggtattgctacttatcaactcacacacctttatcaaaccctccaaggagattcttcattagattctcctcggcaatttactaaggaggcagaagctgagttacagcttgtagaacagatgcttcagcaacaacatgcctcctggctacagccacaaaagcctttgcttttgtttattcttcctaccccccattctccaacaggacttttaggccaattcatagacaaatctgtaatcgtaatagaatggctctttctatctaatcagtgaaatctttgcaagtttatctttctttaattactcaacttataacaataggtaggcataggtcaaaaatgcttatgggatatgatccagataaaattattgttcccttggattcccaacaacaggccacagcatgggaaatgtcgactgcatggcaaatcacttttgcagattttgtgggaataatagataaccattatccatcagacaaaattttgcaattttataaagttcacccttttatccttcctgtaattactcatcacaagcctattccaggtggacagacttattttactgatggctcttctaaaggccgtgcagctatttatggacctaaacatactcaaacaataatgacctctggggtttcagctcaacgctcagacttaattgcagtcattcaggttttacagctgacagcttcagatcctatcaacattgtctgtaattcagcttatgttgtaaatgtagccagttgcatagaaactgctacaattaaaaatacactagacccagaactgcttaatttgtttctaagacttcacacagctattggctctccttcgtctccttttcatatttctcatattcgctctcacacacaacttcctggaccactatctctaggtaatgatagagcagataaactgatgagttctgtgtttcagcaagctcaagcgtctccatgcatttctgcaccaaagtacttctgcctctactcgcatgttccatttstctcgcagccaagctagggctataatacaagcctgtcctacttgccagcatgtccctggagccgcacctgtagaaggttgtaacccatgaggtttggctccaaatgaaatctggcaaatggatgttacacaagtagcagcctttagtaaacttagctatgttctacgaattatagacacttattctcatatgctgcatgctacatgccaaacaggtgagacagctggtcatgtacggcaacattgtttgtcatcatttgctcatatggggatcactaaacaattaaaacctgacaatggaccagcttatactagtcatgcttttcaaatattcttacagctttgagctataacccataaacaaggaatccattataatcctagaggacaaggaattatagagttggcacatcaaacattacaacaagtgttgaaaaaacagaaagggagggataggagaccacttcacacctcaaacaaaactacacttagccttattatctttaaatttttttgactcctggtagagatggtaagactccagcagaaagacattggcaagtgttagaggaaaagaggaaagtttatccgaaagtgttattgaaatcccccggagaagagacaatggaaaggtctgttggatttactgacgtggggatgagggtatgcttgtgtttttcagggagatggacaagccgtgtgggtgccctcaaggtggatgtgaccatggaacgggagactagaggaacccagggtggccaactatgggcctggtccctctggtctgagccatgagccagctgagctagagtgcaaagatggagagaaggccgaccggagtccagacgacatcaacccccataacctgggagcaactcaagaataccaatcaggaagctgggaaactactggagcatcagagccaggcaaaacaccctgattccatgttcttggccatgttagtcataatgtcctgtgtggtatgttttccctgtgcagaggcaaaaacattttgggcatatgttcccaatcccctagtagtacaacctatgctttggagtgacactcctcctgagatttatcgtgatcaggaagtatgggctccaggacccctaactcccctgacaatagaacagttagactctcagaacaatgtcattaattatacgaccccacgagaaggactcctcttgtgtatcactacaaagacatcgcttaactgtagctgtcttataattcaagctcaacaatggttgagtcactatggaaaagtcatgtgcctattaagtcttggttctattaatgtaacaggtgtgctaaccaaccattcccggcccaatcaccctaatcgtgctgactatatggaatggattcccttcgatagttactaccccccctcacatggacccaatgtcttgacccactggctagaaaacaatctatgttaagtggagacattgtggattggggacctaaaggtcttctgtatggaagacatgaaaatcagaaatcatggcacaaacttcgctggcattggtgggaagattttaaagcttcttctttataccacaccgggatctaatcccagtctgccacccagattgcttgacatggagcaggctttagcccgcctcttcctcagtggcattatctagggaggaaaggaccaatccaagagatgttatggaaggcagcactcccatttatgaatggagcatctgggttcgggatactatccagtgatagcaatagtaagcaacacagtcttaatgttacatttgtaaagaatatcaccactcaatttatggtttgtctttttaatccttatgcttttttggcgactaagaaggaccagctccaggtaaacaatatccaattgacctgtaaatcttgccagttatgtcactgcattaatcatagcacattgcaaacacataatgtctctactttgataattttgggtcgcatccctgggctatggattcctgttaatctgtcccagccttgggctaccacacctgctttgcactttatgaaacatcttctaactcagcttactcattgtgcccgtagagccttaggcatgataatttttgctattgtttccttggtcacattaataacttccgttgtgatgtcctctgtagctttgcatagttctattcaaacaactcagtacatggaaaactggatgcgtatagccaaccaagcatggccacttcagaataaaattaacactgagttacaaactgaagtggcattgttgaaatccacggctctatggttaggagaacaagtacaaagcttgcaattgcaacagcaattgcatgatcattttaatcacactcatatttgtgtaaccaacttagaatataaccaaagtgagtatccatgggaccttgtgaaagcccatttgcagggagcttgcacatccaacatcacctttgatatcggtgaattacaaaacaaaattcttgatttaaatggacaaactcaagagtttcagccttctttagaagacgagaccaaattccagcaaggcctggagagcctcaacccttggaccagtctaaagcaccacattaacatcttatatgtagtccttggaataatgttgttttgtctctgtcttctgttcatagtctgtaaaactggatggactgccaatcagaaaatgagagctgcccagcctgaccttacattctttcaattaattcataaacagaaagggggata

SEQ ID NO: 39 - DNA, 5937 bp, Homo sapiens
  repeat_region (1)..(5937): hervk9i
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
agtggcacccatacgtgggggctcgaatccaggttgaagggtcgccagagcgacggttggagaatggagaactaagctggaggacacccgagtactcttaaagcaatccccgtggtgagtaagaaggggagctcggaagcgtcagggtaacaatgggacaagtgtgggctctggttcgttccaccttggaactttttcacactgatgatgaggaggaacgagagtatagcgaagtaacagaagaggttacagagcaggtttatttgccagctaaagctaaagtggcaaaggaggaagaggttcatccctacccttctgcaccccctccttattattttgaagaaaaagagtggcctgaccctccagatctttcttttccggaggacactgggcgaaaagtagttgccccagtgactgttcgagcagcgcctcgagcgaccgctctcagttctattcaggcaggaattcagcaagctagacgagagggtgatatagaggcttggcagttccctgttagaatacaccccccagatcaacagggaaatattatagctacatttgagccttttccttttaaattactcaaaaaatttaaacaagcaataaatcagtatggaccaggttctccttttgtaatgggactgttaaagaatgttgctgtttccagtcggatgattcctactgactgggacactcttactcgagcttgtctaactcctgctcagttcttacaatttaaaacttggtgggcagatgaagcttccattcaggctgctcgcaatgcccaggcccaacctcaaattaatataactgcagaccaacttttgggggtcggcggctgggctggtttagatgcacaagtggtcatgcaggatgatgccatagagcggcttagaggagtgtgcattagagcttgggaaaaaatcacttcaggtggagaacaatacctttcctttagtgctataaaacagggaccaagagaaccgtacgttgattttatagctcggtatctcttaatacaggagtctcttaaaaagatgatttcagattcggctgctcaggatatagtgttgcagttattagctttcgacaatgctaatcccgattgccaggctgctctgcgacctatcagagggaaagcacatttagttgattatatcaaggcctgtgatggtatcggaggtaatctgcataaagctaccttgttggcacaggcaatggcaggactgagagtggataaaggaaatactccatttcctggagcttgttttaactgtgggaagcatggtcatactaaaaaagaatgtagaaaaaatcagcgagtcaggccaccagataggggaaaaaagaaaactgctgagcctgaaatatgtccaaaatgtaaaaaaggaaaacattgggctaatcagtgtcactctaagtttgataaagaagggaacccgatttcgggaaacgccatgaggggcccgtcccgggccccattctaaactggggcatttccggctcaggccattccctcacccctgtacaatgtctgtcccccgccacagccagtagtgccacagtagatttatgctgcacaaaagctgtgagccttctgcctggggaacccctgcaaaaggtcccaacaggagtctgtggacccttgccagcagggacgataggattacttttaggaaggtctagtttaagtttaaaaggcatacaaatacatacaggagtcattgattcagattacaatggggaaattcaaattgttatatctacttctgtttcctggaaagcagagccaggagagcgcatagcacagctcctgattgtgccgtatgtgggaatgggaagaagtgaaattaaacgaacaggaggatttggaagcacaaataaacaaggcaaagcagcttattgggtaaatcaaattactgataaacatcctacctgtgaaataactattcagggaaagaaatttaaaggtttggtagatacaggagcggacatttcaatcatttctctacagcactggccgtctgcgtggccaattcaacccactcaatttaacatagttggagttggtaaagcccctgaagtatatcaaagtagttatattttgcattgtgaagggcccgatggacaacctgggactattcaaccaattataacttctgtacctataaatttatggggaagagatttattacaacaatggggagcacaagttctaattccagaacaattatatagccctcgaagtcaacatacgatgcatgaaatggggtatgtccctggtatgggactagaaaaaaatttgcaaggtttgaaagaaccgcttcaagcggaaaaacaaagttcccgccaaagtttaggaaataatttttgatggcagccattgttaagcctccagaacctatacctttaaaatggttaacagataagccaatttggatagaacgatggctgctaagtaaagagaaactggaggctttagagaaattagttactgaacaattagaaaatgggcacatagctccaacattttccccttggaattctccggtttttgtaattaagaaaaaatcaggtaaatggagaatgttaactgacttaagagccatcaattcagttatacaacctatgggagcattacagccaggattgccttctcctgctataattccaaaaaattggcctttaatagtcatagatttaaaagactgtttctttactatccccttagctgagcaagactgtgaacggtttgcatttacaattcctgcggtaaacaacctgcagcctgctaagcgtttttattggaaagtgttgtcacagggcatgttaaacagtcccacaatttgccaggcctatgtggggcaagcaattgaacctactcataaaaaattttcacagtgttaaattattcactatatggatgatatatactttgtgctgcccccactcaggaaatattactccaatgttatgatcacttgcaaaattcgatttctcacgctggtttaattatagctcctggcaaaattcagactactactccttactcctacttggggaccttagtaaatgacactaccattgtgccacagaaagtaaccatacgtagggatcaactgaaaacattaaatgactttcaaaaattactaggggatattaattggatacgacctgctctaggcattcctacctatgccgtgagtaatctgttttctatccttagaggaaatcctagtctcactagccctcggcaattaacaaaggaggctgaggcagagttacaactgattgagaagcaagtccataaagctcaaataaatagaatagattcagagaagactctagacttgctatttttttcaactcagtattcacctactagtgttttcgtccaagaacaggacttagtaaagtgactttttcttccacatactaattcacggactctaactccttatttagatcaaatcgctactatgatagggattgggagaaatcgtattgttaaattacatggatataatcctggaaaaattattatccctctcatgaaggcacaaatacagcaagcttttataattagtcttacttggcaaacccatttagctgacttcgtgggtattgttgataatcactttcctaaaacgaagctgtttcagtttttgaaattaactaattggattctccctaaaataactaaatttaaaccaattgaaggtgctgaaaatgtttttacagatgggtctagtaatggtaaagcttcttattctggatcaaaaagtaaagttttccagacgccctatacttcagctcaaaaagcagagcttgtagctgtaattgaggtattgactgcttttgatatgcctattaatgtgatttctgattcttcatacatggttcattccacacagttaattgaaaatgctcagttatgatttcatacagatgaacaactgatgactttatttacccaattgcaaacagcagttagaagtagaatgcaccctttttacatcactcacattagggctcatacacctcttccaggacctttgactgaagggaatcgaatggctgatcgcctagttgctaatgcaatatctaacgctagacactttcacaatttaacccatgttaatgcctctggtctcaaacacagatacagcattacctggaaagaagctaaaaatattatccagcgatgcccaacttgccaaatggtacattcctcatcttttacaggaggagttaatcctcgaggattggaacctaactctctttggcaaatggatgtcacacatgttccctcgtttgggagactagcttatgtacatgtatgtgtggacaccttttctcactttgtctgggctacatgccaatcaggagagtcttctgcctgtgttaaatgtcaccttttgcagtgttttgcggtgatgggcattccagcttctattaaaacagataatgccccaggctatactagccaagctctagctacatttttctctatatggaatattaaacacattactggtatcccatataattctcaaggacaagccatagtggaaagaatgaatctctccctaaaacagcagttgcaaaagcaaaaagggggaaacagagactacggaacaccccatatgcaattgaatctagcattattgactttaaattttttgagcctgcccaaaggccagatgctatcagcagctgaacagcatctacagaaaccagctgcaaagacagaagcagaacaactggtttggtggagagatccgataacaaaaagttgggaaataggtaaaataataacttggggtagaggttatgcttgtgtttctccaggccaaaatcaacagccgatttggataccatcaagacacccgaaaccttatcatgagccagatgccgaggaagagattccgggaggatcccgaggaccccccggttgcagccatgtcaagactgacgctgaggaggaccccaactgtcacgagcaacacccgttgaacacagccacccacctggggacagatcaagaagctgtcacagatggcggaagaaaacctgaggaaagcgggacaaccggtcacaatgaataatttaatggtagctatgatagtggttatcaccactgtcatgagtattccttcaataaggggtgacacagagaacaattatacttactgggtctatttatcaatcttggctggcaataatgcctggatgcaatcactttatgacacagttacacatgctttctgatctcggtatttaccataatcaatctgctcctataatcgaggcataccgccctcaaaaacctatttgtaaacaggattggacccagttagaaaaaatgaacgtacttgtttaggaagattgcattgcagaacaggcagaggtgtcgcacaacgattcctatggaatcattagtagttggtcccctaaggggatgtttagctcgaattgcacctctcagtctgcgtgccatggccacactatgttcagctggtctgaacaaaacggtcagatggtagatataataataagtatagcaagagttcctattatctggaaccatggcggtatagtggcacctcaacctcaaaagatatggcccgctctaggagcttagcgtaaggatttaaaattaaaagaacaaatatttaaagcatcccaggcacacctgaccttaatgccaggaactggagtgcttaaaggagctgcagacgaattagcagctagtaacctattaaaatggataaaaacacttggaagctctgtgatttcaatgatgactgtgcttttaatctgtgttgtttgtctttgtatagtctgcagatgtggatcccgactcctgcgaaaagtagctcaccgtgacaaagccgcccttgcttttatctctttgcaaatcaaagaagggagaca

SEQ ID NO: 40 - DNA, 5262 bp, Homo sapiens
  repeat_region (1)..(5262): hervkc4
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <309>: DATABASE ENTRY DATE: ____-__-__
ttctggcgcccaacgtggggcccaaaagaatctggtgaggaaacgctcaagcatgtgaaacagaggaccaacgaacaaaggactcccaaggacataaaagttttaacctctacaggtaagcggggcgcccagagaaagctagggacacaatgggaaaaactgaaagtaagtacaccacgtatttgagcttcctacggcagctcttcaagcatgcatggtggggtaaaagttgatacggaaaatcttatggatttgtttcatgctatggaacaattttgcccttggttcccaaaacaggaaactttgaaattaaaacattaagaaggagttggaaaggaccttaaaagagcatatagagaaggaaaggaaattcctttgcctgtttggtcgctttggtcattggtgcatgcagcactggagccttttcagacagataatgaggctgagtcagaggaggagagagaggagtttgataatcagaactctgaaccacctctaccgagtactaacaaaaaggagagtctgaagatgatttatgccaatctccccagtctccctaaacctactcaaaaaattgttcagcccacggttcctgtagagaaatgtccagaatggccacctcctcctcagccgagtgggtgcagggggagggagcccgagacttggctcaccgtgcccattattgcccgacccacagttcattatggagatggggcaattcaggttcaccctacagttattacagtgaaggagcaatttcccttaaaatggatgacccggcgccccgtctgggttgaacagtggccgctccctaaggaaaagttgggggtgctttataaaataaactactaaaaaaaggatatatttcacccactttctctccttggaattccccagtatttgtaattaagaaaaagtccggtagatggcgtcaacgctgtaattcaaccgatgggagccttacaacctgggctcccatcccccactgtgctccctaaagactgaccgcttgttattatagatttaaaagactgcttttttacaattcctttagcagaggcagatttcaaaaaatttgcctttaccattcctgccgttaataacaaaaaacctgcagccaaatatcattggaaagttttgccccagggtatgttaaatagtcccacagtttgtcaaacttttgtaggcagaactatccagcctgttagagatcagtttccagatttgtgcagcaaaaagtagagaccaacttattcaatattattaatctttgcaaaagacaattacaaatgctgaattacttatagcacctgacaaaattcaaacaaccactccttttcagtatttgaaaatacaagtacaggatagagccattaagcctcaaaaggttcaaattagaagagattctttcaaaaccttaaataattttcaaaaattgttagaagatattaattggatttggcccaatttagcaattcctacttatgctatgtctaatctcttctcaatattgaggggaaataccaacttacgcagtaacagagaactaacacccgaggccatgaaagagttatcagtaattgaaaacaaaattcagcaagcccaggtcagtaggattgactcagacttgcctttataattcattgtgttccctacttcacactaaccacacaataatgggggttattgttcaaaatgatgatttagttaaatggtcctttttgccacataataccataaaagcacttacagtatacttaaatcagatggcaattctaattggacaggctcatatatgaattattaaactttgtggcactgagcccaataaaaattatagttccaataaataaaaatcaggttaaacaggcatttattaactcagttacatgacagattaatttaacaaaatttgttggatgtattaataatcattatcctaaaaacttttcaattcttaaaattaactacataggttcttccaaaaattacttgtgatgcccctttggaaggagccatagctgtttttactggtgggtctggtaaacatgaaaaagcaacagtctggtggagaccacataatccaatcacttgatctgaatttactaacattcagagagctaaggttattctgtgtatttatttaaaaactattacagccttaagtttgctctggagcccactctgtgtggtctttttcttcaacttcaacaattactagaccaaggtacacatcctacttttattacacacattcgagcccacagctctctgcctggcccattggcttacggcaataatcaagcagaccttcaggttatgacatcactgcttgaccaagccacccaatcacatcgattattccaccaaaattggagaaacttatctaaataatttcaacttacacagaggctggctaaacaaattatcccacaatgcccagattaccagctcacaggcacataccctccttcaataggtgttaaccgtaaagaattggaacctagtcagttctggcaaacagatgttaaacacatcctaaattttaaaaactaaaatatgtacatacatccattgttaccaacactcatctaattattacacatttaaaaaaataaaagtaaaaaaaagactaagacaaaaatcaaaaaaatacaaaaaagtaaaaaaatttaaaaagttataaaaatgtacctttagtaaaaaaattataaaacataaaaagttaagacatgttaaaaattgtctgtaaaagtcataaaaaaagttataaaaaatttatataaaaaaggttgtttaattttgttttaaagatctaaacaagttttaaaatgataattgtaaaaaattccgtgtgtaaacatatttactaaagttaaaaagatatcatccagttttctataaactaaacattaaaataaaacacaagtttttcttaaaacactaacctgctctttaaaaattgtaaaaagtctcttaacacagacgccactcctaaaatttccagtaccagcctaaagactacatcctcatcaaaggataaaaaattaaaaaataaaaaaacatttgaaccagcctaaaaaagaccctacaggaactacagcctcaacaatgcgacttccacaaacaacacaggcctcagacattatactaaaaaaacaaaagtctaagccaaataatttattcatttttaattctctcactttgcctactacctatacctgctacactgtattaagctcgtatcttaaatccgcctttcttctgccctgttactttaacaaacacccccttctcagcttctaataacataactgcttagctagaataaattaacatacccccagtggggttcctcattaataacatatagtaaactaagatgccaagtaacactacaggtcactcttttactaaaaaaaaaagttactaattatactcatgtttgtcttctgttatttactaatcctagaatacaaagccaaaataaaaacagtgacctcctcgcctaacaaacctgtggctacaacagcccaaaattatacctattgggcatgtgtcccattcctgcctttaattaggcctgtcacatggttaaaacccccagttgaagtttatgttaataatagcgtttggatccctaagcctacaaatactcatgggccctctcacccaaaggaaaaaaaaaaaagttaataaatgtgtccataggttatcagttcccccctctttacataaggccaactatcggttgcctaaaaggctaccgacaacattgactagttaaaattccaggtcataatcaaagaccagtatcctatcatttattttctggatggagcccggatcattcacagagttcaattcaattaacagtttaagcccccaaaaaagaggtgccaacaaccttaacaatggtcaaataatttaaaaatattaattaaaaaaaattacatctctgatcacactatggtactacaaaataattcctatgaaattgtcattaattggtcccctgaggggacctttacagttaattgtacccatcaaaataataaatacaagacaaaactaaaacagaaactatactatcaaaaaggtaacactacttacactgaaaaacgtgctcattttcccataatttggaccaattttagtacagctggcccacatcccaaaataattaatccaataataggccctaaacactccaaattatgaaagttaataatggcccaatctcatatttaagtttagaaaaaaatatattatctttaaaaaaaaaaggttaaaaacttcaatttgcgtatcagttttcttccaacaaaacagtgcccattcagagttgtgtcaaccctccttttatgttaatggtcaaaaatattgacattcgacctaattctcaaactattacttgtcaaaactgtcaccttttcacctgtattaattccacgttcggtgtaaaaacatctgtgttactgataaaaactaagaaaggagtttggatactggtttccctcaatagaccttagaaagcctctccttccattcatattgtcacaaaaatgttttaaaaaaaagtgtttaccaaaacaaagagatttatttttacccttataacagtcttatgggccttattgcagtcacagctactgctgcggctgctggaattgctttacactcctctgttcaaactacaaaatatataaatagttaacaaaaaattcctcaaaattgtggaattctcagacccaaatagaccaacaattgacaaatcaaacaaatgatcttagacagactgttatttaaatggaagatcgtacaataaacttaaaacatcaattagaagtacaatgtaattgaaatacttccaatttctacataactccccattcgtataatactactaaacatcatttttaaaaagttagacatcatctaaaagaaaaaaataaaaatttaacattaaatataaccaaattttaaaaaaacaggtttttaaagcatctcaggctcatttaaccctcctgcctgagactgacattctcattggagctactgacggactttcaaatataaatcctcttaaacagattaagaccattaaaggatcaactattacaaattttactttaatgtgtatctgtttatgctgtttacttttagtctacagatgcaaaagacacttctgaaaacagaccaaacaccacaaataagccataatagcaatagcggttaaaaaaaaaaaaagggaggggggca

SEQ ID NO: 41 - DNA, 5654 bp, Homo sapiens
  repeat_region (1)..(5654): hervl
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gattttggtaccaggagtggttctagaggaacagaatattaaggatggagttctttcgttggttttggggtttctggagttggctgcttaatatgattagacccaaaaatgctaaggactctacttctaatagtatggagaacactgatagtccttggcatgaactgtttagagagttatgcaaaataaatgcatttgacactcctgattcaccgctcatgagaggcaaggagtttagtgactctatacataatacctttgaccatatgtggagaaccaaggaacataatgaagctggttggttgctcctaagttcagtggacaaagtgatgaaagaaaatgatgaactcagggattctgtctcccggcttcagaagcagatactgagcctcaaatctgctaagattgccctgagtgagagtcttatctcctgtagagaaagagctgaaattgtggaaaaacagacacaagctcttatcatgcgagtggctgacctgcaatgaaaggtgcatgcacagcctcgccaggtgtctactgttaaagtgagggcattgattggaaaagaatgggaccctgcaacttggaatggggacgtgtgggaggaccctgatgaagctggggacactgagtttgtaaactctgatgaaccttttttgccagaagaaacagcttccccatccccagtagtggcaacatcccctccccgacccatgctgccatcagcctttccacctttgtctgaggagataaaccctgcgctgcctgaggcaacagtgatggcctcccctgaggcagttgccaggcaagataatgttgattctcctcaggagccacccccaacacccctgtttgcttctagacctataactagactaaagtcccggcgggcccctagaggtgaggttgagagtgtgacccatgaggaggtgcgctacactcgaaaagaactgtttgagttttctaatttatataaacagaaatctggagaacaggcatgggaatggatattaagggtgtgggataatggtggaaggaacatagagttggatcaggctgaatttattgatttgggcccactaagtagggactctgcatttaatgttgcagctcagggagttaaaaaaggttctaatagtttatttgcttggttagctgaaatatggattaaaagatggcccactgtgagcgagctggaaatgcctgatctcccttggtttaatgtagaggaagggatccaaaggcttagggagattgggatggtggagtggattagtcactttagacctactcatcccagctgggagggtccagaagatatacccttgaccaatgccttgcgaaatagatttgtgagggcagcacctgcatctttgaagagccctgtaattgctcttctctgtatgtcagatctaacggtgggaaccgcagtcactcaactacaaaatttaaatacaatgggaataattggatcccgaggtggcaggggccaagtggcagcactcaaccgtcaaaggcaaggtgggcatagctaccgtaatggacagcagaggcaaagcggcaatcagaatagtctgactcgtgtagagctctggcattggctaattaatcacggtgttcctagaagtgaaattgataggaagcctactgcattcctacttaatttatacaagcagaaaacttctaggtcgaatggacaaaagactaatttgaattataaaaacagagaatcatggcccctcaatcaatttccagacttgagccagtttacagacccagaaccccttgaatgaaggggaggccgggtccccttgaggaaggaccccactacattactgacaatttatgcagtgaatctttctcccatccttccccaaggagacctctggccttttaccagggtaactgtgcattggggaaagggaaatgatcagacattttggggactactggacactggctctgagctgacgttgattccaggggacccaaaacgtcattgtggtcctccagttaaagtaggggcttatggaggtcaggtaattaatggagttttagctcaggtccgacttacagtgggtccagtgggtccccggactcatcctgtggtcatttccccagtgccagaatgcataattggcatagacatacttagcagctggcagaacccccacattggctccctgactggtagggtgagggctattatggtgggaaaggccaaatggaagccattagagctgcctctacctagaaaaatagtaaatcaaaaacaatatcgcatccctggagggattgcagagattagtgccaccatcaaggacttgaaagacgcaggggtggtgattcccaccacatccccgttcaactctcccatttggcctgtgcagaagacagatggatcttggagaatgacagtggattatcgtaagcttaaccaagtggtgactccaattgcagctgctgtaccagatgtggtttcattgcttgagcaaattaacacatctcctggtacctggtatgcagccattgacttggcaaatgcctttttctccattcctgtccataaggcccaccagaagcaatttgccttcagctggcaaggccagcaatatacctttactgtcctacctcaggggtatatcaactctccggctttgtgtcataatcttattcggagagaccttgatcgcttttcgcttccgcaagatatcacactggtccattacattgatgacattatgctgattggatccagtgagcaagaagtagcaaacacactggacttattggtgagacatttgcgtgccagaggatgggaaataaatccgactaaaattcagggaccttctacctcagtaaaatttctaggggtccagtggtgtggggcctgtcgagatattccttctaaggtgaaggataagttgctgcatttggcccctcctacaaccaagaaagaggcacaacgcctagtgggcctatttggattttggaggcaacacattcctcatttgggtgtgttactccggcccatttatcgagtgacccgaaaggctgccagttttgagtggggtccagaacaggagaaggctctgcaacaggtccaggctgctgtgcaagctgctctgccacttgggccatatgacccagcagatccaatggtgcttgaggtgtcagtggcagatagggatgctgtttggagcctttggcaggcccccataggtgaatcacagcggaggcctctaggattttggagcaaggccctgccatcttctgcagataactactctccttttgagagacagctcttggcctgttactgggctttggtggaaactgaacgtttgactatgggtcatcaagtcaccatgcgacctgaactgcctatcatgaactgggtgctttctgacccatctagccataaagtgggtcatgcacagcagcattccatcatcaaatggaagtggtatatacgtgattgggctcgagcaggtcctgaaggcacaagtaagttacatgaggaagtggctcaaatgcccatggtctccactcctgccaccctgccttctctcccccagcctgcaccgatggcctcatggggagttccctatgatcagttgacagaggaagagaagactagggcctggttcacagatggttctgcacgatatgcaggcaccacccgaaagtggacagctgcagcactacagcccctttctaggacatccctgaaggacagtggtgaagggaaatcttcccagtgggcagaacttcgagcagtgcacctggttgtgcactttgcatggaaggagaaatggccagatgtgcgattatatactgattcatgggctgtagccaatggtttggctggatggtcagggacttggaagaagcatgattggaaaattggtgacaaagaaatttggggaagaggtatgtggatggacctctctgagtggtcaaaaactgtgaagatatttgtatcccatgtgagtgctcaccaacgggtgacctcagcggaggaggattttaataatcaagtggataggatgacccattctgtggacaccactcagcctctttccccagccacccctgtcatcgcccaatgggcccatgaacaaagtggccatggtggcagggatggaggttatgcatgggctcagcaacatggacttccactcaccaaggctgacctggctatggccactgctgagtgcccaatttgccagcagcagagaccaacactgagccctcgatatggcaccattcctcggggtgatcagccagctacctggtggcaggttgattatattggacctcttccatcatggaaagggcagaggtttgtcctcactggaatagacacttactccggatatgggtttgcctatcctgcacgcaatgcttctgccaagactaccatccgtggactcacggaatgccttatccaccgtcacggtattccacacagcattgcctctgaccaaggcactcactttacggctaaagaagtgtggcagtgggctcatgctcatggaattcactggtcttaccatgttccccatcatcctgaagcagctggattgatagaacggtggaatggccttttgaagtcacaattacaatgccaactaggtgacaatactttgcagggctggggcaaagttctccagaaggccgtgtatgctctgaatcagcgtccaatatatggtactgtttctcccatagccaggattcacgggtccaggaatcaaggggtggaagtggaagtggcaccactcaccatcacccctagtgatccactagcaaaatttttgcttcctgttcccgcgacattacgttctgctggcctagaggtcttagttccagagggaggaacgctgccaccaggagacacaacaacgattccattaaactggaagttaagattgccacctggacactttgggctcctcctacctttaagtcaacaggctaagaagggagttacagtgttggctggggtgattgacccagactatcaagatgaaatcagtctactactccacaacggaggtaaggaagagtacgcatggaatacaggagatccattagggcgtctcttagtattaccatgccctgtgattaaggtcaatgggaaactacaacagcccaatccaggcaggactacaaatgacccagacccttcaggaatgaaggtttgggtcactccaccaggaaaaaaaccacgacctgctgaggtgcttgctgaaggcaaagggaatacagaatgggtagtagaagaaggtagtcatcaataccagctacgaccacgtgaccagctgcagaaacgaggactgtaattgtcatgagtatttcctccttcttttgttaaaaacatgtttgtgcatgtatacacttgtactaagaaaatatcttcattttatttccttttccttttatcatgtgacataagatttattgacttcatatcagcatttaagtattgttaactttatgtaatagtatttgggttggggattggtgcgtttccggttgtacgaaggatagttgtattatgttaggcgtaattatgaccttattattgtctttatttgaagattatgtatgatctcaggagatgtgtatgggttcaagttgacaaggggtggact

SEQ ID NO: 42 - DNA, 3037 bp, Homo sapiens
  repeat_region (1)..(3037): hervl68
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gcactrtntgggannnttnntggaanggaagaagagggaagatggatgacaaaattatgcctgggtvgctatggagttattcatggtatraaayagcagctragctgctgtctgttatgagaggtaaaagttacctgtgraatttgaaaatgatagatccaatcacagagagttggcnysctggatcccytggctgcttttggccwtkctggctaaagtnaggaaraarcacancycarrtgatgtctttggtttttgttctytcctccarktgggaggagaaagggcccaaacattccnaaangtgagcttnntwtgsaswaaagwyawwaacaktwnnttgnagttntcttctccaggtggnaggngnaangrtcngaaaantnctnnaggcnngnwttgagtgrrccaaraatgttaaaagtttgcattgctctctcctccaagtggaagraaaaargttaaatcagttcccagggctggagyaangctttagataaaccagaggaggagaaaaagtaaaaaaaaagcccnccaaacaagwaaaccactctagccntttctacagcttagctgctgcyacagcaactcaacnccctcctttcmctacaaccttcanctccagcanctgtaatgttaaccytgtaaadtgctnaatttactgctaggggtttgantaaacatghaatgagtaaaaagaaggaaatnattatwgaatsrctttgtattttgtggctattgcatctggatgtatgataaaaattratgtaaaatgttatatgcttgtaatttcataaatgctagaggaatcatcctaatmgggaaagctgcaaagaaaaaaaagttagtggnawcacaactcccttgctttytgctgcyggtgggtggattggaatttaaactctttgagtattggaaasagaacaagtctccataactgatgatttttgcctattggarcctctgnaaaaagggagacaacatnaaaagagaggcaatctccagatggagatacacttttggagttttaaaaanyagtttttagtttgctaatgwgctcttgytgaaatgagatgtctgacccttagaggctgatgattttcagcctgatgtgcatgatttttgagggggtcaatttggactctaaractgacaagataaaaaggmctyttagaaaagccttgcttgtcacttggacttggaatacagctgtctggntcttcagtntctcagctttgctgctgctgaagaaaagccactggcttttttggaatcctgaattcacagatcctaattgcctgtacctgactctaagctgaaacctcatactgtctgctgtgrgctgtttcagcctcgngntgagctgtgctgaactgaaatnngntgaaatggctcgactcaatgaacagaactcagactctgggactgttgcagatttaggaccaccctctgtggggccataaactatgaaaacatcacggatgctggctggactgtctgggtcacatacagatgcccacaggaaagggcttgttctctgatgggaccatctaaaattgagctgctgattggctctatatttctgatacagagactaattgcattcttaacttgtgatttctgtcgaaagctgcaagttgggggagggcacattacaagaagtgtgacccctccacccactcctgacagattggacttgaccccctctcggggatgtctcactgctattgacttgttgtgttcggctttctggattagttgcagtttgcaacaatggactgacagcctgagtctacttccctcacctttctcctggtacacacatcttagtgagacagtttgattattaaatgcagctgtccccagaaagggattgatcttttttttcctaggctgctcaccggataaatgatcaggacgaaaagggtgggaaggttatgtaaactcattttgaaaaattttgaaaattcagaattcatcctgaccaatttctgaacatgatgtgtctttccggttaagttgtataaaaatgtttttctataaaaatgtttttgtccctcttgcatacaacccttccagacaaaaggtctgggtgagagtaagagatgattggagaaatatgaagttaagattgtaagttatgaatattgctgaatgggacacactgattttgtaacaacggagaaaaaagaaaaacctatggaggcacggggtgtgagagagggcattaatgatctttgtttttcagaactgctcctggaagctttcccctcttcctgaagaaaaattccccatgctgcctttccaagctgctgcgagcgctttgaattcaaactgactgctgagcctaagatcacacctgacagcgctgactatgagacagcagggggtggccccagctcctgcactttccacgaagaacacctccagatgtcatccacacacatgagacggatgaactggtgtcatggacaagcaaaactgtttggaactgactgcctttaggcagtccctctgaaaccaaggactaaactgaattaattggactagactctttgggagtagtccccgtggtaagaggccacactggggaccctgttaacctgtactgcctgactaatgtatgtcctgcttggggtaccctaacaattgtaaactctttgtttccaggggtaccacgtgtgccctctgggattgtacttttatgtgtaccctgactatcatgacactgcctcagccctggaaggctttcaggtcagcttcaacttactggccagagttgtgctgtgcctgaattgatgcctcaggccaraaaaaaaaaggttaatacagaaacttaaggaggaagccacctggctttctaagatagacctttatggttaatgggatttgttttaactggctaaattcaggacccctaaagggcataaactgagatcaatactgcaggttggtctcaccctgctgcgtggggtcctactgataataattttgctgtaaagatgccttggccaagggggtggactgtgcagaagag

SEQ ID NO: 43 - DNA, 5530 bp, Homo sapiens
  repeat_region (1)..(5530): hervl_40
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttttgacgatgaggatggatgggatgctgacagagacatggctttctggaagaggaaggatgagggcctcgtgggctaattaacgggatttgaggaaagtctctgggaatcagtagcgaacmtgttgaccaaattgtatgstcaaccaggcaataaatggttcttcactttattgcctgttaatgagaaggattggagaggtggtcgcaggccgaktaccgggaagtaggttcaaagacagctgcccgaatggtgccctggttgttgctaactcttctgctggwgwgggacgtctttatcaatctggagttaccctcaggtccactccactgtaacaaccagtactaagattttgcctggatgggcagaaagttcttccctcttttagacaamaattgcagagatatgtaaccactgtgggcagaaaccaggtgaatcwttagaactttgactggttcacttgggggwtgaggnwgtgaggcacgtaacgcttgttaaggaagaatggcaacagctgggccatcttacggctcagcccctcctkcagtctatcatkccaaccttagatcctggctgccaataaganagttnagggactctcwgagagatttccttgagasaamcaaactcccatgggaaaccatagatgaggcattgantagtattcgggctcttactgncctggatttggtttacagtgctgacgaaggtgatccactggagaatgagaaaccgacccaaagaaacctagataaattcttgcaccagnctgctgccctggaaaactcccctaactcttatgttgaaannaggcgagaacntaagagatgttatggcgatgaggcagcagatgccctggattaaagttgaattntnaaggcaantcgctgntgtgtaagtnaaggccaagtcagctaggggacgcaagcccawkagccccagctagaaaacaatgtctggctatggctgctgagtcaaggggtcctcaaagctgaaataaatggtgtcagtaatsaggaccttgctactcaatatagagctttaggtggaccaaaaacattggaagtttatttggttgagccatgagcagccgntakgccgctcaaaactgaaagtaaatgcaaagccttgcttantggcacagagctgctctctccctacatgctgcctgctcccctcccagncaccctaatttcagctgctttaaggaaaaaaataattagaaacgggactaaagtttccccgtctaagggggatcgaagtccatacacacccatctgagtatgctggggaanttkngggaggggaggaactcaaacttttatggctttgttggatacgggcgcccaagtcaccatcctacctgmactcctgtggaaggaaaaggcgcccggattcaggtaatagggtttgagcaaggtttgcagtagggaaaggaaantaatgtgaccttctgggtggancctctaggccaattcaatgtactgtgntgctgcttccacatctgaatatatagtaggaattgatgtttatatgcttgtacttccctgtctcataagtgtcagaggaaatctcctawtcgggaacagccacatgtagagaagtgctagtgggacacwtwmatttatctgtcaccaggcttcctatcscccmctgkkcggtccaacasagacagtatagaatcccwggaagaagaaagggaatctgtgccctgagtaaatactaatacctataggcggcagaggtagtaagagatmcagkatctcwacasaacagccttgtatgsccagtgmaaaagwctaacmggagcwggaggctkacagtggawtgttwccmawtggattcagttkttkctcccgtggccccagctgctscagacatcgtgactstakctgaatccactacacggamtwatggmacwtggtgcgctgttttgaacattgmcaacgmcttmtttsccataccagaggcatctgaggatcaakagmwgttcgcgtccatgtggcaaggcctcwaacacgtgtttgtwgtmctcckccagkgwtacctaaactcccctgccatttgccacmagtggatgggtcaggatttagcgcgagtkcctctaccctctgatgtccaaagctttcactatatagatkacgtcctgttggttggcaagtcagaagcctccgtmtcaacagccctgactgcggtgttatcacacttctacananagaatggctgataaactccaaaaacattcagggacctgcttgccaagtaaagtttcttggaantatgtaggcagattcacaktgcntaatccctccggcagtcaagaaaaagctgtctcttcaggcccccgscaccaaagaggagcaccttacttgactctttggntattggagacggtttgtgcctcgcttgggcattctacttggtcctttatattagctancctacaaatcagtatcctttgagtngggcccgaaccaaaaggctgcgttggaanctgtccagnaagctgtgncacgctctctacctttggggcctcacaatcctaatgacacctttgagctacaaktmtctgtaactgatgattttgccaattggagcctctggcaaggggaggcaacctccacctggaggtaccccttggggttttggactcactttcctcctgataaggctaccagacacgccccttttgaaaagtagctattagcttgctactgagctcttgtcaaaactgaacacctkwcccacggaggccttgtgactctccagcctgatattcccactttggggtgggtcaacttagactcaatgactaataaggtgagaagggctcaacaagcctcgcttgtcaaatagaaatggctatattcaagaacgcagctngnctngccccagcggcatctnagctttacatgaaaaagtggcagctatccctttgggggaaactttatcccccactccgccgcccgaagcaaagccgctggctcaataggaccctcgattcacagaggttcncctaaatgctgggcctggttcactgatggtttggctaagctgaaacctaatggtgtccactgggctgcggcagctgttcagcctcagcgncagctmtgnaagactgaaaaccgacaaggtcgctcagctcaatggncagaattcaaagccattctcataacctggacaatactccccttgataaasnttgttatatttttactgacttacgactgttgccaatggcctagccgtttggtctgccacttggaagactacagactggcagattaaagacacccctctttggggccgtaaactatggaaacaaattgtggctnccgattagacaatctgggtcactcatgtagatgcccangtaagggcccgttttctgatgagaccaaatggaatcaagctgctgatcgagcctgcaccgcccagattgctacaawtgctgcctggatccatcatcctaccggacatggcaacacatccaccatcanagactgggcacaaagtaaaggaccgtatgtttctgatgcagaagctaccactgcatgccagacttgtgactcctgccaaaagttgacctgtttkttctgcggtgagagaggccacattgcatagggcattgcccctgtccacttctggcanattggctacatcgaacctttgaccncctcttagggctaccgatgntgcctcaccactattgacacatttttcagnttatggtgttgctgttccagtccaatcagccgactctagccacaccattgtggcccttgaaacgaanctgtgtnatgttttcagctttccagactatttgcagtctgacaatggtgcaccttttatcacaaaagccactcaacaatgggctgatagtcaaggtattcaatggaccttccacgctccctactatccacgagcatctggtattgttgagcgttggaatggccttctcataaactgactcaaaaagatttctgactctwtctccctcacctcctcctggtccacacaccttagtaggacaatttggtcactnaatatggctgtccccggaaagggtcatctccttttggccgcttcctgagtaatgatcagtacaaaaggagagtgcgggaggttatatagacttattttgaaaattcgggattccgcctgaccaatcctgggcatgatgtttctttctttcccctaatagcaaccccaggccagcctggttggtacatcttccaggtggcagcccggccaaaagggganctagggaattcaaacttaattctggttcagccacctgkattctcttgttggattgacatgattwtagatcatnaggataatgaccacttggttgagtatactgcttkccgagtccccstatagtggcccacatggncaaagtggggaccataatgagtctctgtangtttstataaaatgcctttgtccctcttncacctgattgttctgaataaaagatctgggtgcgagtaggaaatgactggaaaaaaggtgaagttatagntactggaatgggacawgccgattttntagcggtggagggaaagcaacaaccctgccacctgggaagggaanaccttagaccccgggaagtgcgggggaataaggggcattaakgntctctttgtcttttagatcmagcaccgccacctagcaaaacaatcatattgtctcctggagccaagcagcagctgcagctggcaatctgacctgctgctgggtttgtcatctccttccacatgccatgaaaacaggaaaactcatgtggatatggccggtcctgaactattctgctatgcctgatgccatcaatggcagcttcccaacatggatgtgtacaaacacacgawccagcacaacwttgtttcaatctgactgatacaaatttatatgcttctcctgatgtctgaacagccttgggttataccatgtatggctacwgaggctgcaaatactcagtgacactgcccatgtggcttaaccaaascgatgtaatgagatcaagtttgacaacaaatcccgaattggtaacctttcggattntatgtttatatgtgggggagagtgggccatggaatgtctctccattggkgatgggggttgctttttggcccatctattgctccctgtaattattggcaatgacaccaaagattatcaggtcagtctaaactctcttntgtgggtcgtaatggataatagactggccttagacaacattctggctgtctaaaataagacctantggtcccgttcatgggatttgttcagctgattgagtccgggaccctgnggggcatggttgaggtyaatactgcaggttggcctcatcctgctgcttggatgtcctgttgatagtagccttaattaaatgctntatgagacaaattgaacagatttggtcccagcctctgtcagtcagattaatcagaatggctgatagagtggcgtactcatgkgaaaatttaccagaagccaagatggtgtaggamcgaggggtggatat

SEQ ID NO: 44 - DNA, 7392 bp, Homo sapiens
  repeat_region (1)..(7392): hervr
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgggggctcgtccgggatttgagaggcggccagaggacaccggccccttttccttttcggcagaaaccgcgcggccccggccaccggtggcggacggacgacgggacgactcttgtgtgtagtcaggtactttatttttgttctgtctttaatctctgaggtcggccaaccttcgtaggagtgtagagggaggacagacgtgtcctggaccctcacactccgaccccgggggacgccccggcggtcgtctggaggaaggctgatgacaccgtcagcctcctcaaatctgaaggcaggttccccctgccatctgaatcacttgtagtactttggcgccattctctggccgcgcggctcatctgtttttgtctggtttgtgttgttactgttgtcttatttatatgtgtgtatgagcctaaggacgggacaatgggacagacgctaacaactcctctatctttgactttgacgcacttttcagacgtccgggccagagcccacaatctttccgtaggagtccgaaaaggacgatggcaaactttctgctcgtccgagtggcccacccttcatgtcgggtggccccgggacggaacttttgacctctccgttattttgcaggttaagacaaaggtaatggatcctgggccgcatggtcacccggaccaagtggcctacatcatcacctgggaggatctcgtccgaaatcctccgccttgggtgaaaccctttctccataccccttctacatccaagtccaccctccttgccctagaagtcccaaagaaccggaccctggatccgcctaaacccgtactcccggatgagtcgcagcaagacctcctcttccaagaccctctacctcatccaccacataatcccctcctggaacccccaccctacaactcaccctcgccccctgtcttgtcccccgtttctcctaccaccccttctgcccccactccttcctctcttgtctcctcgtcgaccccgccttcctctccagccccacctgaactcacccccaggaccccgccacaaaccccccgtctccgcctccggcgggccgaaggtcaggatggcccttccacctggcaatcttccctttttccccttcgcacggtcaaccgcacgatccagtactggcccttttctgcctcggacctctataattggaaaacccataacccctccttttcccaagacccccaggccttgacctcgttgatagaatcaattctcctcacccaccagcctacctgggatgattgtcaacagcttttgcaggtccttctaaccaccgaagaaaggcagcgagtcctcctggaagcccggaaaaatgtgccggggcctggaggccttccaacccagctccccaatgaaatagacgagggatttcccctcacccgcccggactgggattatgagacagcaccgggtagggagagtctccgaatctatcgccaggctctgttggcgggtctcaagggggcaggaaaacgccccaccaatttggccaaggtaaggactataactcagggaaaagatgaaagcccggcagcctttatggaaagacttctggaagggtttcgaatgtatactccatttgatccagaagcaccagaacacaaggctaccgtggccatgtcgttcatagatcaggcagcactagacataaaaggaaaactccaaaggctagacgggatccaaactcatgggctgcaggaattagtaagggaggcagaaaaggtatacaataaaagggaaaccccagaagaaagagaagctaggcttataaaagaacaggaagaacgggaagatcggagagacagaaaaagagataagcatttaaccaaaatcctggcagccgtagtgactgaaaaaagggcaggaaagtcaggggaaacaagaaggcggcctaaagtagataaggaccagtgcgcctactgcaaagagcgagggcattggatcaaggactgccccaagcgtcctagagaccagaagaaacccgcccctgtcctcaccttaggtgaggacagcgaataggggtgtcagggctctggagccccccccgagccccggctaactctatctgtaggggggcatcccaccaccttcttggtggacacaggcgcccaacactcggttttgaccaaggcaaacggacccctgtcctctcgtacatcttgggtccagggggcaacaggaagaaagatgcacaaatggactaaccgccggacagttaacctagggcaaggaatggtgacacactccttcttggtggtacctgaatgtccgtacccccttctggggcgagatctcctaaccaaactcggagctcagatccacttctccgaggcaggggcccaggtgttagaccgagatggccaacccatccaaattttgactgtgtctctgcaagatgaacaccggctttttgacatcccggtcaccaccagcctccctgatgtctggttacaagattttccccaagcttgggcggaaacgggaggacttgggcgggccaagtgtcaagccccaatcataattgatctaaagcccacagcggtgcctgtatctatcaaacaataccccatgagcctagaagctcatatgggcattcggcaacacattatcaaatttctagaacttggagttttgcgaccttgtcgctcaccctggaatactcctcttctgccagtaaaaaagcctggtacccaggattacaggcccgtccaagatttgagagaaattaataaaagaactgtggatatccaccctacggtccccaatccttacaacttgctcagtaccttaaaaccagactacagctggtataccgtactggacttaaaagatgccttcttttgtttacccctggccccccaaagccaggaactatttgcctttgagtggaaggaccctgagagaggaatctcaggccaattgacctggactcgacttccccaggggttcaaaaactctcccactctcttcgatgaggctctccacagggacctcaccgacttccggacccagcatccagaagtgaccctgctccagtatgtagatgacctcctcttggcggcccccacaaagaaagcctgcacgcaaggtactaggcatctactccaggaactaggtgagaaaggataccgggcatctgccaagaaggcacaaatttgtcagaccaaggtaacttacctggggtacatactgagtgagggaaaaaggtggctcacccctgggcgcatagagactgtggctcgcattccaccgccccggaatcccagagaggtgcgtgaattcctgggaactgctgggttctgtcgcttgtggatacccggttttgctgaattggccgcccccctttacgcactcaccaaggaaagcacccctttcacctggcagacagagcatcaattggcttttgaggcactaaaaaaggcactcttgtctgccccagcccttgggttaccggacacctcaaagccctttaccctcttcctggacgaaaggcaagggattgccaaaggagtcctgacccaaaaattggggccttggaaaagaccggtagcatacctgtccaagaagctggaccctgtggcggccggctggcccccatgtcttcgtatcatggcagccaccgctatgctggtcaaagactctgctaagttaacccttgggcagccactgactgttattactccacatactctagaggccatagtgcggcagcccccggaccggtggataaccaacgcacgcctaacccactaccaggccctcttactggacacggaccgcgtccagtttggccctccggtcaccctaaaccctgctacgctgctgccggtaccagaaaaccaaccaagcccacacgattgtcggcaagtactggctgagacccatggaacacgagaagaccttaaagaccaagagctcccagacgcggatcacacctggtacacagacggcagcagttaccttgactcaggtactcggagggcgggagcagcggtagtagacggacacaataccatttgggcacaatcactacctcctggcacgtctgcacagaaggctgagttaatagcactaaccaaggccctagagctgtccaagggaaagaaagctaacatttatactgatagccgatatgcctttgcaacggctcatactcatggaagtatctatgaaagaagaggtctcctaacctcagaaggaaaggaaatcaagaacaaagctgaaataattgccttattaaaggccctttttcttcctcaagaagtggctataattcactgccccgggcatcagaaaggacaggatccagtcgcagtaggaaacagacaggctgaccgagtggccaggcaagccgccatggcggaagtactgaccctagccacagaacctgacaacaccagccacataactattgaacatacttatacctccgaagaccaggaagaagcaagagccataggggctacagaaaacaaagacactagaaactgggaaaaagaagggaaaatagtccttccccaaaaggaagccctggcaatgatccagcagatgcatgcctggacacacttgggtaatcgaaagctaaaattgttaattgaaaaaactgactttctaatcccaagggcaagtacactcatagagcaagtgacatctgcctgtaaggtctgtcagcaggtaaacgctggggctacccgagtgccagcagggaaacggactcgtggtaaccgcccgggagtctattgggaaatagacttcactgaagtaaaacctcactatgctgggtataagtacttactagtgtttgtagataccttttcaggatgggtagaagcctttcccacccggcaagaaacggcacacatagtagccaagaagatcctagaagaaatctttcctagatttggacttcccaaggtaattgggtcagacaacgggccggccttcgtttcccaggtaagtcaggggctagccaggatactggggattaattggaaattgcattgtgcttatagaccccagagctcaggacaggtagagagaatgaatagaacaataaaagagacccttactaaattgaccttagagactggcttaaaagattggagacgcctcctatctctagctctattaagagcccggaatacgcctaaccgctttgggctcactccatatgaaatcctctatggaggacctccccctttgtcaaccttacttaactccttttctccctccaattctaagactgacctacaggcccggctaaaaggactacaagcagtacaggcccaaatctgggcccccttggcagaactgtaccggccaggacattcgcagaccagccaccccttccaggtgggggactccgtctacgttagacgacaccgttctcagggactggagcctcggtggaaaggaccctacattgttctcctgaccacacccacagccataaaggttgacggaatcgccacgtggattcacgcatcccacgccaaggctgctccagggacgcctggaccgacgtcgtccggaacttggagactccgccgctccgaggacccccttaagataagactctcacgcacttgacttcttacttgcccttgtcctcctaccccgcgccgtacatagcagtaacccctcatatagtccaagatgggattcacaacaaagataatcttcttatacaacctagtactggtctacgcggggtttgacgaccctcgcaaagccatagaactagtacaaaagcgatatggccgaccatgcgattgcagcggaggacaagtgtccgagcccccgtcagacagggtcagtcaagtgacttgctcaggcaagacagcttacttaatgcccgaccaaagatggaaatgtaagtcaattccaaaagacacctccccaagcgggccactccaagagtgcccctgtaattcttaccagtcctcagtacacagttcttgttatacctcataccaacaatgcagatcaggcaataagacatattatacggctactctgctaaaaacacaaactgggggcaccagtgatgtacaagtattaggatccaccaacaaacttatacaatctccctgtaatggcataaaagggcagtctatttgctggagcactacagctcctatccacgtctctgatggaggaggtccattagacaccacaagaattaaaagtgttcagagaaaactggaagaaattcataaagccctatatcctgaacttcagtatcaccctttggccatacctaaggttagagataacctcatggtcgatgcccagactttaaacattctcaatgccacttacaacttactcctaatgtccaacacgagcctagtggacgactgttggctttgtttaaaattaggtccccctactcccctcgcaatacctaacttcctattatcctacgtgactcgctcctcggataatatctcttgtttaataattcccccccttctagttcaaccgatgcagttttccaattcatcttgcctcttttccccctcctacaacagtacagaagaaatagatctaggccatgttgccttcagcaactgtacctccataaccaatgtcaccggtcccatatgcgctgtaaatggttcggtctttctctgtggcaataacatggcatacacttatctacccacgaactggacggggctttgcgtcctagcaactctcctccccgacattgacatcattcccggagatgaaccggtccccatccctgctattgatcattttatatatagacctaaacgggccatacagtttattcctttactagcagggctagggatcaccgcagccttcacaacaggagctacaggcctaggtgtctctgtgacccaatatacaaaattatctaatcagctaatttctgatgtacaaatcttatctagcaccatacaagatctgcaagatcaagtagactcattagccgaagtggttctccagaacagaagggggctagatctacttacagcagaacaaggaggaatctgtttagccctgcaagaaaaatgctgcttttatgttaacaagtcagggattgtgagagacaaaataaaaaccttacaagaagaactagaaagacgtagaaaagatctagcttccaacccactttggactgggcttcaagggctcctcccttacctcctgccctttcttggccctctacttaccctcctgctcttactcaccattgggccgtgcatttttaaccgtctaaccgcttttattaatgataagttaaacataatacacgctatggtgctaacccaacagtatcaggtgctcagaaccgatgaagaagctcaagattgagcctctaagacacaagaaaag

SEQ ID NO: 45 - DNA, 6069 bp, Homo sapiens
  repeat_region (1)..(6069): hervs71
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ggatccaaaatagccaccctgcagacggccttgctcaccttttctgtcatcccataacttttccagtgcccttaaataacacactatgtacacaaacctatgcctgtgctgctttactctgtctggacccttattctatccccctgtggctactctcctaccttaggaaagatctgagtggcccctttcctccttacccccatcccttaacccacacagctcgttttcctgtgtcacagcaagtccagcacctccaagacttggctctgctctccatcctaaaacccttaaaagaaagggctgagtttgaactttttgcctttgagtcggggagacaccaaagatatttggctataagtcaaaaaggaaggggggggtcacataggtcccactggcctcagacccacctcttgtcctctctctagatctcaaagcttaaagagacagatcttatgtggcaagaaatgttggctatagttgttttcctacttcttctggttataatacttctgttcttccaatactacagccccccaggccatgaatatctctgtctgtgctgggtttaatatttctgcttaaaccttgttaattgcctccagaatgggaaactcttcttcctggccccgtagagattacagccctctccaatgtatgttgcagaatttctctctgggttctcagaggattacggagtccaccttaagaaaggcaaactccagacactctgtgaagtagaatggccacagtttggaactgggtggcaccagaagggtcattaaacctcacaactgttcaggctgtgtggcgggtcatggctggaactcccggacaccctgatcagtttccttacattgatcaatggctagatttggtccagagccctcctccatggctccgctcacgtgccattcatgatcccacctccaaggtccttttgagctggaccacacttttgccccaaccctcacgtcggctcctcctgtacagtctccttctgaagaagaggaaagttctcttcacccatttctgcctccctataacctcctgcccaccccccccccccgccccagaatatttccttgtctcctcgactacatcccctgtggcctctccacctatagccacccaattacggcatcggctggagaggtggccctccttctcccactgacagaggcccaaatcctctgggcaatgaggctctgctccatttttagtttatgtccccttctctgtttctgacctgtacaactggaaggctcataatcccccccttttctgaaaagccccaggtcttgacctcactgatggagtccgtgctccggaatcaccggcccacctgggatgactgtcagcaacttcttttaacccttttcacctctgaagagagggaccatatccgaagaaaggtcagaaagtatttcctcacatcagctggtagaccagaggaggaagcccgggacctccttgaggagacttttccctctacctggcctgattgggatacaaaatcctcgggtgggaagagagctttggataattttcactggtatgtccttgtgggtatcaagggagccactcaaaaacccatgaatctgtccaagacaactgaagctgtccaggggcctaatgagtcaccaggagtgtttctagaacgcctcctggaggcctatcagatttacaccccttttgacccggaggctcccgagaatagccgtgctattaatttggcatttgtgactcaggtagcccctgatattataagaaaattacaaaagctggaaggatttgctggaatgaacagcagccaacttttcaaatagcccagaaagtttttgacaattgagagtttgaaaggcaaaaacaggtagctcaggcagctgaaaaggctgctgacaaagcatcaaaaagacaggcaaagatcttagtggctgccatccaaggaagcaagaaggcagggcccccatcacagagcaccagccaggggaccccaggtccccaccagaaaggccaaaaaggtgagcaggctcccctacaaagaaaccaatgtgcttattgcaaacaaattggacacaggaaaaaagaatgctcattaaaaccagaggaaaaacaagagaagaaaaaggtcctcaccctccctgctgtggatgaatctgaagattgacagggccggggctgccacttccttcacccccaggagcccttggtgactgccacagtgggggcccagcctgtatgcttcctaatcgacactggggcggaagacttggtactgcaaacacccttgggcagtgtctctaataaaaaggtggctgtgcaagggacttcataagcttcataagctgcaggcatccatctccttctcagcccaataagctcacctcacattaggggacccaacaccctctaccacccagctcctgctaaccacccctttgtcagaggaatatctcttagtttcaccctcacaaccgctggagaataaaactaatcctctcctactggatttacagactctctttcctcaagtctgggccaagtcaaacccccccaggactggcaaagcaccatctgccagtagttgtagaactcctggccactgccctgccagtccaggtaaaacaatatcctatgagtcagtgggctagagagggaatcaatccccatattcagtctgcctggaatactccatttttgctggtccagaaacctggaacaaatgattaccggcctgtacaggacttgcaggaagttaacaagtggacagtcactgtccatccaactgtccctaacccttatattttactcggcctgcttccaccagaacatacagcatacactgttcttgacttaaaggatgctttctttgctattcctctggcccctaaaagccaacctatatttgcttctgaatggatggaccctggctcaggagacaccactcaattaacctggacttggttaccccagggtttaaaaaattcccccaccctttttggggaagccctccaacaagatcttataccgttctgagccagtcaccctaactgcacgcttctccagtacatagacgacctgtttttggctactgaaaccactgacagctgcctgcaacatactagggacctactttacctccttcaggaactcgggtattgggtctcagccaagaaggcccagctttgtcttcccagacttttctacctaggatacaagataaacaagggagaaagggcacttgccactgctcgaaaggaagccatcctgcaaatccccactcccaccactaggagatgggtacatgaattcttaggggctgtgggatactgtcgtttatggatattggggttcgcagaaatcaccaagcccctgtacaccactaccagagggaatggcccacatgtttggactgacaaagaacaggcttttcaaaatctaaagaaggcattaactgaggtccctgctcttgccctcccaaatatctcagaaccatttcatctttttgttcatgaaagccagggagtcactaaaggggtactcactcaaactttaggaccatggtgatgcccggtggcctatttgtctaagatactggaccctgtggctccgggtgaccaagttgtctgtgagccatagcggcaaaagcaagcctggtccaggaggctgataaactgactctgggccagaatttaacccttatggctcctcatgccatagagactttgctacaaaggcgctctggcaaatggatgtcgaatgctcacatcctgcagtatcagagtttactgttagatcagccttggttaactttctctcccacaaggtgtttaaatccagctacctttctccctgatccagaccttaccacacctgtccatgactgccaagaactgttagagactacataaactggccgacctgatctccaagatgtgcctctaaaggaggtggactccactctgtttactgacagcagcagcttccttgaacagggagtaggaaaggctggtgcagccgttactatggagacagatgtactgtgggcccaggcactgccggcaggtacctcagcacagaaggctgaattggtcaccttcactcaggctctctgatggggtaaggacaaacgtattaacatctacactgacagcaggtatgtttttcctactgtacatgtacacaaagccatctatcaagagtgagggctactcaccaggaaagactattaaaaacaaagaagaaattttggccctgcttgaagctgtttggcttcctccgcaggtggctgtaattcactgcaaatgtcatcaaacagaaggcatggctattgcctgtggtaaccaaaaagcaggctctgcagctcgagaggcagcttggctcccagtcacgcctttgaccctgctgcccactgtgtcctttccgcaacctgacctaccagaccacccacaatactccccagaggaagaaaaacaagcttcagatctttgggccagtaaatatcaggaaggtttggtggattcttcctgattccagaatctttattgccccaagtcccctgggaaactttaatcaatcatctgcattctgccacccatttgggaggaataaaactggcccagcttcttaggagccatttcaacatcccccaccttcaggacttaactaaccaagcagctctctggtgtatggattgtgctcaggtaaacaccaaacaaggtcctaagcccagctcagtccaccctccagggaggctctccccgagaaaggtgggaagttgactttacagaaataaaaccacactgggcagggtataaatacctcctagtgctaatagacaccttttcgggatggactaaggcatttaccactggaaacgaaactgccaccatggtagttaggcttttactcattaaaatcatctctcaacatgggctgcctgttgccatagggtctgataatggaccagccttcacctcgtccatggctcagtcagtcagcaaggcattaaacattaaatggaaactccattgcacctattgaccccagagctctggacaggtagaacgcatgaaccacacaataaaaagtactcttactaagttaatcctagagaccagtgagaattgggtaaagctccttcctttagcccttcttagagtaagatacaccacttactgggctgggttttcaccttttgaaatcatgtatggaagggctcctctatcttgcctaagctaagggataccaatttagcagaaatctcacaagctaatttgttcagtacctgcagtctctccaacaggtatgagacaccatccagccacttgtccagggagcacactccaatccagttcctgaccagactggccctgccactttttccagccaggtgacttagtataggttaaaaagttccagaaggaaggattcactcctgcctgaaaaggacctcatactgtcatcctcaccacgccgatggctctgaaagtggatggcattccttcttggattcatcactgtcacatcaaaaaggcgaacaaagcccagcaagaaacatggatccccaagcctgggccatgccccttaaaactgcgcataagtcaagtgaagccatcggattaatcatttttatttacctcttttgtttgtttccgcctattacgccctctgcccctctctactcttttctcctcacttctttcacgacagtatgtgtgtttgcaaacaccacctggaaggcaggaacctccaaggaagtctcttttgcagtcgatttatgtgctttgttcccagagcctgcccaaacccatgaaaaacaacccaacctgccggttatgggagcaggaaatgtcaacctcgctgcagggtccagacacacaggaagccggactagatgtggaagctctaaaggtgcagaaaaaggactccagagcgttgacttttacctctgtcctggaaatcaccctgactctagttgtctagattcttatcagtttttctgccctcactggtcatgtgtaaccctggccacataccctggaggattgacctggtcctcaacacttt

SEQ ID NO: 46 - DNA, 319 bp, Homo sapiens
  repeat_region (1)..(319): hir
  ref <308>: DATABASE ACCESSION NUMBER: Database of repetitive elements (repbase)
  ref <309>: DATABASE ENTRY DATE: 1996-01-26
gattcccaggtgcacagagatcctaatccgcatccatcgaaatctcacaaagtgtccataaatcactcagggagggcccccatggatacagggccgtagtaggatgctcctatagtgggcattaatatgagaatgaccgaaaagtgcatttaggaccatattataattttcgggttcccaggtgcacgtttccaataaccaggtgcacggatgtatagggtcccccccatggatagaggtccgtgttagggtgctccatatcgggcatgaatatcaggaacaccggcatgtgcacttaggaccatgttttaatttttca

SEQ ID NO: 47 - DNA, 1158 bp, Homo sapiens
  repeat_region (1)..(1158): hres1
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ggctcgctggggataatatcgcagctgaaaccgaacatcaagctggcttttcaaaccttcagttatttacattagactgagaggggaaaagcgctaagagtgcaagagcagagaaagagcaagaggaaacttgaaaaggcggatcacgcaatgcgctgtgcacacgcccccgccccgcgcacccgctaccccacccgagcccccagcggcccgcgtcccccatcccggtcccaagcccagacacctccgagatccgtcccgcggctccggccgcgccaccgccaccctcaagacccccgcagcccaggcccggccccgcgccaccgacgccccccgcggcccgacccgcgcgccccgccagcccgggcctcgtaccgtaggtttcggacatggccgtctgcgacatcttgggagcggcgccgcctctcgccgggtcaccgtgcactcgcccgcggtccgccggcgcgtctcggtggggaaggacctggggcgggggaccggaggagggaggggcccgaccggtccccacggcaaccgccggtcctcccagcggctgcggcccagccggactccagctccgcgcaggcgccagggccctccaccctccgtccggccgcgaccgcgaggaggaagaggagatgggctacgcgaggcccggcccaccccgcgttcgcgcgtgcgcacggggaggccggggcggggcgcgtgaggacttcggcgcgcgccggaagcacgtgcgcgggctgggcgctctggcggtgtgcgctgaggtgggcagagcggcaggtgggggcgttgggggctgagtcccgatttccctgagggagggtcgggtagaggcgggcggtgggcaggtttgggggtgacagagggctggggacagtggggtccagttgccggacagaggaggaaggtgcccgcactggggaggaaagcagtccatttgccaaattggcccgtctcagttaagacgttgtcttcggtcatcatctgcggctgtcagccaggaaaaaacttccctgacgctgttacgatggaggccagaacttggttaatgtgtaacaaggaggcagtaggccccaggtgtccagccagaggccgccctgtgaatgggaggcaggttcatttacccgttggacccgttgggaagctaagctt

SEQ ID NO: 48 - DNA, 631 bp, Homo sapiens
  repeat_region (1)..(631): hsati
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gantcngctcnngacacaactctctgagccttcggtgacctttcngtctngtgtaanngcactcntgtcyycctggcagcagttggacctcgcgatgtggattgtgccctcacccagcnntntttatgccctntcnccatggtgacnggattaggggtctcctgctcttcnntcctaaggaccactgtctgtgctgtgtctttcaaaggtcagaagagattgnacctttgtgtttttattttccctgtgtttgctttttctcnntggggaacctgtgttgctgctttgaaggtatattcatactggccnntcanntgnncaacatcnncaaantnactagttanggctttcaaaatatgntatttcaaaaaattanccgtctgtattttccatatgcagttataagtaggtttcatcggttatgttttattcctcagtttatacatttgattattgtaccaagcagagtacctttgaaattttttttcatttaaaaaatatggatctttaaaaaaaaattatatatgatatatattacatgttatgtgctatgccttatntgtaacatataacctcatatattttntatgtcatagtatataatatttatcctgtgtcatcttatatatac

SEQ ID NO: 49 - DNA, 59 bp, Homo sapiens
  repeat_region (1)..(59): hsatii
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
antccattcgggtccattcgatgatgatcacactggatttcattccataattctattcg

SEQ ID NO: 50 - DNA, 1287 bp, Homo sapiens
  repeat_region (1)..(1287): hsmar1
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttaggttggtgcaaaagtaattgcggtttttgcattgttggaatttgccgtttgatattggaatacattcttaaataaatgtggttatgttatacatcattttaatgcgcatttctcgctttacgtttttttgctaatgacttattacttgctgtttattttatgtttattttagactatggaaatgatgttagacaaaaagcaaattcgagcgattttcttattcgagttcaaaatgggtcgtaaagcggcggagacaactcgcaacatcaacaacgcatttggcccaggaactgctaacgaacgtacagtgcagtggtggttcaagaagttttgcaaaggagacgagagccttgaagatgaggagcgtagtggccggccatcggaagttgacaacgaccaattgagagcaatcatcgaagctgatcctcttacaactacgcgagaagttgccgaagaactcaacgtcgaccattctacggtcgttcggcatttgaagcaaattggaaaggtgaaaaagctcgataagtgggtgcctcatgagctgagcgaaaatcaaaaaaatcgtcgttttgaagtgtcgtcttctcttattctacgcaacaacaacgaaccatttctcgatcggattgtgacgtgcgacgaaaagtggattttatacgacaaccggcgacgaccagctcagtggttggaccgagaagaagctccaaagcacttcccaaagccaaacttgcaccaaaaaaaggtcatggtcactgtttggtggtctgctgccggtctgatccactacagctttctgaatcccggcgaaaccattacatctgagaagtatgctcagcaaatcgatgagatgcaccgaaaactgcaacgcctgcagccggcattggtcaacagaaagggcccaattcttctccacgacaacgcccgaccgcacgtcgcacaaccaacgcttcaaaagttgaacgaattgggctacgaagttttgcctcatccgccatattcacctgacctctcgccaaccgactaccacttcttcaagcatctcgacaactttttgcagggaaaacgcttccacaaccagcaggatgcagaaaatgctttccaagagttcgtcgaatcccgaagcacggatttttacgctacaggaataaacaaacttatttctcgttggcaaaaatgtgttgattgtaatggttcctattttgattaataaagatgtgtttgagcctagttataatgatttaaaattcacggtccaaaaccgcaattacttttgcaccaacctaa

SEQ ID NO: 51 - DNA, 1301 bp, Homo sapiens
  repeat_region (1)..(1301): hsmar2
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cgaggggtcttcaaaaagttcatggaaaatgcgtattatgaaaaaactatgcatggatttcaaaaattttttgcaccaaaataaactcgtactaacttgttataacatgtctgaacaggatctagtttgaggcactaagaaggataagacatcagtttgaaaagagcccctatcagagcaacatgaattctgctaaaattgaagcaagaacaaacatcaaatttatggtgaagcttgggtggaagaatggtgaaatcactgatgctttacgaaaagtttatggggacaatgccccaaagaaatcagcagtttacaaatggataactcgttttaagaagggacgagacgatgttgaagatgaagcccgcagcggcagaccatccacatcaatttgtgaggaaaaaattaatcttgttcgtgccctaattgaagaggaccgacgattaacagcagaaacaatagccaacaccacggacatctcaattggttcagcttacacaattctgactgaaaaattaaagttgagcaaactttccactcgatgggtgccaaaaccgttgcgcccagatcagctgcagacaagagcagagctttcaatggaaattttaaacaagtgggatcaagatcctgaagcatttcttcgaagaattgtaacaggagatgaaacgtggctttaccagtacgatcctgaagacaaagcacaatcaaagcaatggctaccaagaggtggaagtggtccagtcaaagcaaaagcggactggtcaagagcaaaggtcatggcaacagttttttgggatgctcaaggcattttgcttgttgactttctggagggccaaagaacgataacatctgcttattatgagagtgttttgagaaagttagccaaagctttagcagaaaaacgcccgggaaagcttcaccagagagtccttctccaccacgacaatgctcctgctcattcctctcatcaaacaagggcaattttgcgagagtttcgatgggaaatcattaggcatccaccttacagtcctgatttggctccttctgacttctttttgtttcctaatcttaaaaaatctttaaagggcacccatttttcttcagttaataatgtaaaaaagactgcattgacatggttaaattcccaggaccctcagttctttagggatggactaaatggctggtatcatcgcttacaaaagtgtcttgaacttgatggagcttatgttgagaaataaagtttatatttttaatttttatcttttaattccattttccacgaactttttgaagtcccctcg

SEQ ID NO: 52 - DNA, 842 bp, Homo sapiens
  repeat_region (1)..(842): huers-p1
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aatttgggggctcgtccgggattgcccttgtggctacctgcccgtggtttggtagcccccctctggcgatggatccagaggccagcccaagtggccgcctagttctcttggactgggggctgactctggtactatctctctaccggtggggcgctgccgacccaatgtgcatggatttaattgcaatrgagaaatagtcctggggagacatcccataactgtagccctatcacagggtgtctgtctgtagccccattgcagggtgtctgtctgtagccccattgcggggtgtctgggttggtgagtattctaggcgctgccaacgnccccttccttctcctgactkgttctgtagccccctggtggggtgtctgttggtagccycacggggtgtctgtctgtagccccatcatggggtgtctgtctcagtttagctcctatggggtctcwgttggctctccctaactagtaggaagagtctgtggttrgggagacttctcctcaatcaggaagatttcagggagatttctcagacggagaataggagaatagtttggaagggatactcttggatttgagacttggtctgggatctgtgttttgaaggccttctgttcgtcttatctttgtgtgtgtttgtatatgtggaggggatctctgaaggaattgctgatggaagtccagcaggcctaactcagagaaccctccttatttgtctggtcacatttggtgagccctaaagaaagctcaacaggcctgtctyggggtgactatctgctcttcgccttgcccagagaccccactgtgaattaccatttggaggtcatccctccccacctgga

SEQ ID NO: 53 - DNA, 3088 bp, Homo sapiens
  repeat_region (1)..(3088): huers-p2
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
actgggggctcgtctggaatcagcagcagggtgatktacagatgwggaactgtcggatgtgcctcttttctaagaccctgccacctctctttcttntgggtaaaaggctntgtttcccttcacagaggtctcgctgkcacgcgggactggagcagagwcctggggcwactgaaggcatcwtttgctggaaggccccgasactgaactctgtcggccaggacccccagacttcgcttggtgtnttttctctctctcacagtttamaaatggctcttatctcctttataatgttaagngttttgctacaggctgcggcaatgttactaagtanaatgagcatttggctcagccatcaaaggtgcaaatcagaacaatgtggtttccattttttcttagaggtgccatscttgcccccaccctganagccacaggcgcgcacggcgcagggcacctcccctccttaccccctcccctcccggctcaggcgcctgggcgtgcccacggcatgcaaaagccgcgcccaacagccacgaagggtgggagaaaaccgaggctgccgctgggaccccacggggctggctggccggtgcctcctctcagccgcgccaanggaacctttcctnccctggccaaggaatncaaactagtctgaaccggggaaaggatacaataattaaagggacncatttgcactgagcaaggggttcttccccccgactmccccctttttgncctttaaactgtttttcttttttccttttctaagtgagagggttccctncccakcactctgcttctgatagggaagttaacagaggassagcgacccctgctggcggatagctgcaaattcggcagggcncatttgagacaatctaaacagatagatncagcccctnaaatatctttttagtcccaaacttgattccaagcttcaggttgaggccctagaaagaaaaancagatctgagggatccaaagccaggcaacaggcacaatgtaaatgggcaggaccaattcctgctgactaaacccccgccccatggaaggaggccatgctccttggcataaacgaggcccagggaactcaaaggttgtcgacagcagggaganagggaggcataggcgagggcggatcattcctwntctccgggccttccctgcttcatggatgaatgccacattngcacccatgggtggcacctgccaaggtcaccgggactcggggataaaaagtggaaanngaaaggannatgctcgctttctctccccatcacaccctgagttttcactgaaagaaggaagggaaatgagggacgcctctattccctgtctttcagaacgggcaaccagctctcttcaccacccccagcttatactcctctggagtgtatcctgaaccattgggactgctttgaccctcggaatctgnaggaaaaacgcctcatagccctctgcacaaaggtttggccaaattatgacttacaasaaggactagcttggccttaggaaggaaccgttcattttgataccatncggctgttggaccttttctgnaaacgtgaggacagatggtctgaggccccatatgtgcaggctttctataccttgcagggcaatccagacctttgccgacagtgtaggattgatccagccctcctgtttgccatctcaggagaggctgcaaggggcaatcccagggaactaaagawacgagtcccagaggcacccccagcagagaagccagctccctcnagccctgctcctccgggtccaccctgacctccctatccagcttcagcctctcacttgccccctcctagaaattctcaccctagacaagccccggtctcactcttgctcctccaacagatgcctggtgaatttggccccagtaaggtccaggtccccttctctctacaggacttaaagcaaattaagggggatcttggcaagttttcagatgaccctganagatatatagaggctttccagaatttcanccaaatatttgaactctcctggagaganagttatgttacttttgaatcagaccctgatggacactgagaagcangccgctctgcaagcagcagagagatttggggatgagctttgtatnacatatagcatcaggaaagggggcgaatnttatccaactggaagagaagcagtaccagtgaatgaccctggatgggatcccaatgatgagatgggagactggangaggagacactttcaggtgtgcataaggagggcttacgtaggactaggaccaaacmcctsaactataccmmgttatccatgatngaccaggaatttgatgaaaatctcattgccttcttggaaaggctaagagaggccttggtaaagcacacctctctatctcctgattcagtcgagggacaactaatcctaaaggataaatttattactcaggcagcccctgatatcaggaggaagttgcagaaacgggccctgggaccagatagtactttagaggacctcctgaaagtggccacctcggtcttttacaatagagacagaggnccaggaccttgagttcagtagacacaggnaagagacctgggaagcttnagtagccaccgtgtaagcccacaaaccccagaantnccaaggtgnacctgttaactgctaaagatatggcaagaatagttanctccttctaaagtttatntgctctcgtacaagstttaatttcttncaccagggstgacccaamasctcagggtacaatnttgctgttagtatatttcacttcttatttctgtaatctttggcactanattctttccttgtataatacacgtttaacccatgcatacttaaccttatagaackkgttttttttttttctcacgcctagaggccatcaaactccaaatggncaggcaactgaagcctcggacaatgactcccctttgccaggaacccttagatagacctctgggagaaatttgactgccgttttccccaaaacaacgccccctgtcggcaggaagtagctaagaccggtcatcgtccatattctaatggcagttagatgtgcctcttcagagaggggaaa

SEQ ID NO: 54 - DNA, 8919 bp, Homo sapiens
  repeat_region (1)..(8919): huers-p3
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttttggggsattggcnaggataccaaggtacaacattcattgraacggtgagtataggagcgractccaactctgtcctttcattccgaggctctcttggcctccattttaaaatcaaatcaaatcaataacgggtatccgtcagccagttaaaaacgnttagcgcggctgccgntcttaaagactcggatgwcaggcttgctggggagaacatggagaatcccccagcacccacgggttgttgggaatgttggccatgtttgaaccagcttcctttcacggagrrcctagccgtcacgtggggctggaagaagtcctgaggcaactgaggatttctggccggggctacaccccggtgttatccaaaggcttctggaccgaccccagcctccgacagcccattggggtgttggcaacaggatctccaancttccttttgctatcgcaatttcctcctttcctntctcagtsaccatgtctcttatcctctctgtgtatgcaatgtgcgggaatttttacagttcagggaagtaatcctgttwgacaagatcagggaatgtcgtagtaaccagggatatagctcaagggaaggcgtctttgtgattttctaggaacagagggcccccacatccccagtgaacatctctctctgcccttggtctggagagcacatggmacttccaggtctctctctscccttggtctggagagcacatggcatntcaaggctactgcccttggtctggacagcacatggcatttcaaggtcaacagcgccacctagtggaataggaatcctctccatgaggcacattgtcggtccttcaccgaaacactctagcttcccaattctcccctctttttgcgcctctctactagaaatcaggcttcatgcyncttctgtgaacgggaaaaytctgctttcaacarytaggagtaaaatatcctccgwagccaaattttagtctcgatactgtcccatcagcaggaaaacggccattcggtccctacgttcttttaaggcacctattctgtctccaattaraatggtacttaattagtaaggggattttaagtycggaagttaaccggaaccatttttctctaagggtaaatgctttagcatgggccataatagcaggatatagagctcaatctagcacgctccctccgttaaaggggncttgcccaaatgcaactgttacatagtctctcccgagatccattttttagggagccacgcaggtcacacaagtctaggaggtcaaagggaaatcacaggcagaggactagggctgcttgggtaagcgtgactaatcccaacacttagttcctccggttccatggcttggagggtcacgcctgcaaccatgggcggcacatttaacaaggtgccgggacccaggaaccanggagggaaaacagcaggggggacgccccctactgtcttcctctccaccctgggtcayaccaaaaggaaggagactaaaggaacgcttttwttctcacttctctttctagatgggtaacagatcatcttcagcctgcactcctctggagtgcattctgaagcactgggactccttcgaccctgagactttgaagaaaaagcggctcattttcttttgcacaagggcatggccttcttaccatcttggggacgaanargcctggcccnntgaggggagccttaattttaatattatccaacaattagatcttttctgcagacaggagggcaaatggtccgaggtccttatgtacaggctttctttgccctgcgagacaacccagacctttgcaagcgttgcamaatcgacccagctcttttagcaatcatatcaggcaggnccaaagagaatgattccccaaaaytagaaaagcaacttccaggggaaccatctgaggcagctatcgaatgtcccagcccttccagtcccccttatctggggccacctccaaccacgccaccagctcctccasctccaccatctccaaaatttcccactcccccaccttcactcttacccctacaggaaatgcccgatggaggtgatgccactagggttcaagttcccttctcattacaggaccttaggcaaataaagggagacttaggccgattttctgatgaccctgataggtatatagaagctttccaaaatttaactcaggtatttgacctcwcatggagggatgttatgctgctcctaagccaaaccctaactgcngctgaaaaacaggcagctctgcaggcagcagagaatttcggagatgagcaatatgtctcctatagyaggccaaaagggaaaagagaaaatagggaaggcgaagaaataggggaaacaccattcccaataggaagagaggcagtacctcttgacaaccctaattggaaccccaatgacgcagkagatgaatggaaaagaaaacactttttaatgtgcatattagagggcctatggagaaccagggccaaacctcttaattactctaaactgtctatgatagancaaaagccagatgagaatcccgcagcctttatggaaaggctgagagaggcactaataaaacacacctccttatcccctgattcagtcgagggacagctaatcctgaaagacaagtttattacacagncagctcccgatattagaaggaaactacagaaacaggctataggaccagatagcaccttagaaaacctcctgagggtggccacctcggtcttttataatagggaccaggaggaggcccaagagaaggagaggaaacacaagwgaaggacagaggctctagtagccgctttgcaggcttgcaaagtccaggatccccgaggtgcatctgctagttgctatcagtgtggcaagtcagggcactttaaaaaggagtgcccaggcagcaagaagaagccacctcgaccctgtccagcctgtggcggggaccactggagatcggactgcccccggaggcggaggtcactgggttcagaaccagtctcacagatggtccagcaggactgatgggtcccggggctcaaacccctggctccagcggctcaaactgccattacagcacaggagccccgggtgattctggaaattgaaggaaggaaggtagacctccttctggacactgaagccagtctctctcctctcctctccaatccaggcctcccctcttcccatagcacgaccatgaggggcgtctcaggaaaaactctaacccgatatttttctcaaccccttagttgcagttggggggacctatgtttacacatgcctttttaatcatgcctgaaagtcccactcctttattaggtagagacattctagcttgcatgggggccagcatccttatggccccaggacaaactctttgtctcccnctggtggaagctaatattaatccggaagtgtgggcaactcaaggaagaatwggtcgagctataaccactaggccagtccagatccatcttaaggatcccacttcttttcctaaccagagacaatattccctaaagccagaggctaggaaagggctagaagccattattaataacctgaagatgcagggcctcctcaaaccctgtagcagcccctgcaacaccccaatattaggagtgcaaaaacccaatggggaatggagactagttcaggacctctgcctcattaatgaggccgtagttccaatccatccagtggttcctaatccctataccttgctgactcaaatacctgagggaactaaatggttcacagtcctagatctaaaggatgcctttttctgtataccattacatcctgactctcaatacccgtttgccttcaaagatccctccggccaaaccgcccagttaacatggacggtgctgcctcagggattttgagatagccctcacctgtttggacaggcactgtcaaaagacctctctgagttctcccatcctcaggtcaaggttttgcaatatgtagatgacattctgctctgtgccccaactgaggaagcttctcaggaaggcactgaagctcttcttaatttcttagctgacagaggatataaggtttcaaaatccaaggcccagctctgcmaaacctcagtgaagtacctgggtttagtgctgtctgaagggaccagagcattaggggaggagaggattaagcmcatttcctccttccccctccccaaaaccctcaagcaactgagaggattttggggcattacaggattttgcaggctatggatacccgggtatggtgagatagsttgccctttatatcacctcataaaagaaactcaagcggctaaaactcatctcctaacctgggaacctgaagctcaaaaggcctttaaccagctaaagcaagccttgcttaaggcaccagctctcagccttcctgtagggaaggccttcaatctttatgtatcagaaaggaagggaatggccctgggagttttaactcaggcccgaggaccagntcaacagccagtgggttacttgagtaaggaacttgatttggtggctaaaggatggccagcatgcctccgagccgttgccncagtggccctactggtcccagaagcctccaaattaaccctgggaaatgacttaactgtttataccccacataatgtggcaggattactgtcctctaggggaagcctttggctaacagacagccgnctccttaaatatcaggctttgctgttagagggwtccacmatccagttaaaaacttgctctcacctaaacccagacactttcctcccngaggaaactggggaacctgaacatgactgtgaacaaatcgtagtacagacctatgcagccagggaagatctcagggaaactcccctagaaaatccagactggaccctcttcatggatgggagctcctttgtagaacaaggaatccgtaaggcgggatatgcagtagtcactctaaataacgttattgaaagtgcgccwctctctccaggcacaagcgctcaattagctgagctgatagctcttacaagagcacttgaattaagcaaaggaaaggtagctaacatttacactgactccaagtatgctttcctagttctccatgctcatgctgccatttggaaggaaaggcactttcttaccactaatgggtctcctataaaataccatcaggaaattaacaggttattatcctcagttttccttccacgagaagtagcagtgatgcattgtaggggacatcagaagggaacagatgaaatagccaaaggaaacaagttagctgatcaggcagctaagtcagcggcaaggaagcctcaaggcatcaacacacttcaagcccctctaatctgggaaggctccataagagaaattaagcctcagtattcccctacagaaatagaatgggccacttctcgagggtatactttccagccctcagaatggctacagtcagaggatggcaaactccacttgccagcctccagccaatggaaagtccttaaaatccttcaccaagcttttcacttgggaaaggataaaacttatcaatgtgcccaaagattgttttcaggagagaacttactaaaaacagtcaaacaggttgttaatgcttgtgaagtctgtcttaaaaataatcccctgaacagacggctccttcctcctcaaacccaaaggatggaaagctatctaggggaggactggcagatagacttcacccacatgccaaagacaaagggcattcaatacctcctgkwgtgggtanataccttcactaactgggtagaagcatttccatgccgtacagaaaaggcctctgaggtagtaaaagtattagttaatgaaataactccccgctttggtctacctaagtacctccaaagtgacaatggcccctcatttaaggcagccgtcacacagggggtctcaaaggcactaggatacagtatcatctccattggcttggagaccccagtcctcaggaaaggtagagaagacaaacgatatcatcaaaagacacctcagaaaactgtcccaagaaactcaccttccttgggtcactcttcttcccatggctttactacaggtaagaaatnccccttcaaagttaggtctnagcccttttgaaatgctgtatggacggncttttcttaccaatgattttctattagaccaggagacctctgaattggttaagcatgtaacctctctggctcacttccaacaggaattaacacaactagcagaagcccaaccccaggaaataggaccacctttattcaacccagganatttggtattggtaaagkmtcnacctwctctctctccttctctaagcccaancagggagggcctcacaccgttctccttccaacgcccccggcagtaaaagttacaggaatcgactcctggatacatcacactcaagtcaaagcctggaaagctgagggagcaacccccgacagcccagaggaacgtcctgaatatcaatgtgaagaaataggagatcttaagctgaaaatcataaaagataagtaamtgagtgagggctactcatcctactcagtcccacccctacctnagcagatactttckgtcatttctacctttcctctcgaggtkcgccaccaaatattagaacttctttttgamwcatacttgcaggsagmttttgattgtcatgggattgcatttgtaacttcatagacccccaaaggagaattttacatcttggcgagtaaaattttagatggaaattatttactactccacacttgtgggaactgctatmctcactctactatttgcagtagggctatacactgtagcaccctcagagtggaatattggacagagaatctcaattgctatagtattttgcttaattattatccttatagcagggataatagttgmagaaaagaagtgaagatgaaagttttactatcactgagtctgctaggactttttattgggtttagtaatacgtcacaccgtttagctnctacaatatcagccatggcccatttatacagtaagactaattgntgggtctgtcctgagcggtttgctcagttcagtaacactaaggaacctcttgatgacccggaacttaccgtcttaggattccctttgttagctttacctttaaccattaaagacttntcaggcataaatggaacatggtatgggaacactttcaactgggtaactaactcctcccaggaaaacactcctnccccggtgccagaaaacantctccccaaagataagcttcacaccctcaggctaggaaaagttgaccgagtaatagcaaatgcctccctctgctttaaaagcagnggaaaagaaccatacttgggakatctcaaacattgtaacacatcacacttgtaattgctgaaagctcagaggtttggagaagaaaacgcaanaaggatgatctaaaagggaaaatggaagccctacgcgggggggctttcagaatctagcstctcctcctggttggaagtcccgntgggaatggcaggctctaggtaaccgccttgacacatggcactataatgtaaaaaanaacacataggncttcccaaacatgccccctcatggaattccagacccttgtatgatgcttgctaatagtagcggcntacaaatctgtgggcgaacaggagacatctggactgacggcccttgccacaaggattatctgagatattggccagggcatattgtgtccctgatcttttaaaactccatttgtcaggtggacccttctcatttggcgtgtaaaattccaaatggcatcgtgaatgactatcctgaatatggntatccctatcccaaagatgctcctattatatgtaaaaagaggaagcttctaagatatgagaaagatctgcctgtgtctctcacaagccacaacttagaaccgtcccttcaaggaacagggctatatttcctttgtggctcctggatacacttaatcctccctaggcactggaagggaacctgnactatagtngcagtggttcccgacctactatctttaaattccaccganatggcagcatcatctggggacatccctaacctagcntcttttctagagactgcgctatctcggatacancgaacaaagagatctatcatttccatgccctcgtatggagatttaactgaaagagaagactggggaggacatgcacatgacaatcctatcttagaaaaancatggataggggattctatagccagaggcctattctggtttgctggtattcctctccttgaaagatcagtacttaatatttctattatgatgcaacgagggtagaaggcaacagtaggagccatagaagcacaacmacaattcatagactctttagcctcagtagtagcgcaaaatagacaggccctagatgtccttacggccgaagtagggggtacctgtgcacttttaaatgaaacatgctgcttctggatcaacacctctagtmaagtagaggagaatctacaggtgcttaaagatcaaatcagaatcattgacaggctaagagaaaatgcgggctccagtcccaggtggctacaatccctctttaatgaattccagtcttctttatggaactggttagctcctttattaagctccctcttgctcatgtgttttgtattaatatttggaccttgtatactcaatactataactcgaattgtttcctctcgcctagaagcaatcaaactccaaatggtgctgcagaccgaaccacacatagacacgccattcttccaaggacccttagatcgaccccaggaggagccctagctgctgttccccacacgacgccccttttcagcaggaagtagccagaaagagtcgtcgtccaacaccccctaacagcagttagggttaccactccwgagggggggaa

SEQ ID NO: 55 - DNA, 95 bp, Homo sapiens
  repeat_region (1)..(95): hy3
  misc_feature: a is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tagtcaantgaagcagcgggagtggagaaggaacaaagaaatttgtaactggttgtgatcaattagttgtaaacancgctgcactccaaccagcc

SEQ ID NO: 56 - DNA, 854 bp, Homo sapiens
  repeat_region (1)..(854): in25
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gtggaaagttcctcatagcagagacacaattgcagtgctgggtacagtagggaaagtctgcacctttaccccaacaggcaggcagcctctgtgatcatgaagggtcttggagaagggatccttgttccccnctggcnctggtannccactgcagacacagctggggcttctcccacaggaacgcagcatggatgcacctatagacagcattcctggaacaattcagggtgattgcagccccacaggaggagcactctccagattcaggcctncatgagaggcagtcacaattcctccctacttggaacatcaanattnctacagatgaaaagaggtgcctgtctgatctgaatagctggaacactgggacaggagtgaggctgtgaggtggacagntttcctgctgacctggcangnganctgaggtagctcccacccttcaccctganaaaacctcagcacatctaattgagagctcncccagccaccctcatcaaggctgggacctttgcccactattggatattaaatctacccacctactttagctacanctggtgcctacccagggatacctcccttattgccctnaagcctgaatcatcaactcagtaaataaaatactgnsgagggaaaaattaaataaataaataaataaagtgtacacyackagagaacgagataagcttcawgagaycyctgccattccaacyccataggagacagtgaactcgcycacacaccaaghacgtmactactacaaccagcatctgrgaaakycakcacacaaagactctctataacyaaggaactcatacagagtcttcacccctamaagcaccmagagycaaatt

SEQ ID NO: 57 - DNA, 30 bp, Homo sapiens
  repeat_region (1)..(30): ivr
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggaggggcagctgaagcacctggagcag

SEQ ID NO: 58 - DNA, 337 bp, Homo sapiens
  repeat_region (1)..(337): ker
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
agctcatctgtccactgaagatgcttggacagagttaggaatgcttcctgggagaggtaacatttgagactttcctggaagaatggtcagagtaaaccaagtaagtaggaatggaaagaggatgggaggccccagcttcccagaggcataaggtgaggangnccctatgcattcagatgtggcccaccctggggtctggtggactaaagncttggacaccccagatcagccttagtgggatgaggcaggaaagacagctgagggtcagaacccaggcaggtccaatgccagggtgggcatttcgagttggtgagacatttcaccctggtgccaagct

SEQ ID NO: 59 - DNA, 5403 bp, Homo sapiens
  repeat_region (1)..(5403): l1
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gggggaggagccaagatggccgaataggaacagctccggtctacagctcccagcgtgagcgacgcagaagacgggtgatttctgcatttccaactgaggtaccaggttcatctcactggggagtgccagacagtgggcgcaggacagtgggtgcagcgcaccgtgcgtgagccgaagcagggcgaggcatcgcctcacccgggaagcgcaaggggtcagggaattccctttcctagtcaaagaaaggggtgacagacggcacctggaaaatcgggtcactcccgccctaatactgcgcttttccgacgggcttaaaaaacggcgcaccaggagattatatcccgcacctggctcggagggtcctacgcccacggagtctcgctgattgctagcacagcagtccgagatcaaactgcaaggcggcagcgaggctgggggaggggcgcccgccattgcccaggcttgattaggtaaacaaagcggccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagcttcagatctgagaacgggcagactgcctcctcaagtgggtccctgacccccgagtagcctaactgggaggcaccccccagtaggggcggactgacacctcacacggccgggtactcctctgagacaaaacttccagaggaacgatcaggcagcagcatctgcggttcaccaatatccactgttctgcagccaccgctgctgatacccaggcaaacagggtctggagtggacctccagcaaactccaacagacctgcagctgagggtcctgtctgttagaaggaaaactaacaaacagaaaggacatccacaccaaaaacccatctgtacgtcaccatcatcaaagaccaaaggtagataaaaccacaaagatggggaaaaaacagagcagaaaaactggaaactctaaaaatcagagcgcctctccttctccaaaggaacgcagctcctcaccagcaacggaacaaagctggacggagaatgactttgacgagttgagagaagaaggcttcagacgatcaaactactccgagctacgggaggaaattcgaaccaacggcaaagaagttaaaaactttgaaaaaaaattagatgaatggataactagaataaccaatgcagagaagtccttaaaggacctgatggagctgaaaaccaaggcacgagaactacgtgacgaatgcagaagcctcagtagccgatgcgatcaactggaagaaagggtatcagtgacggaagatgaaatgaatgaaatgaagcgagaagagaagtttagagaaaaaagaataaaaagaaacgaacaaagcctccaagaaatatgggactatgtgaaaagaccaaatctgcgtctgattggtgtacctgaaagtgacggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacggctgatctctcggcagaaactctacaagccagaagagagtgggggccaatattcaacattcttaaagaaaagaattttcgacccagaatttcatatccagccaaactaagcttcataagcgaaggagaaataaaatactttacagacaagcaaatgctgagagattttgtcaccaccaggcctgccctaaaagagctcctgaaggaagcgctaaacatggaaaggaacaaccagtaccagccgctgcaaaaacatgccaaattgtaaagaccatcaaggctaggaagaaactgcatcaactaacgagcaaaataaccagctaacgtcataatgacaggatcaaattcacacataacaatattaactttaaatgtaaatgggctaaatgctccaattaaaagacacagactggcaaattggataaagagtcaagacccatcagtgtgccgtattcaggaaacccatctcacgtgcagagacacacataggctcgaaataaaaggatggaggaagatctaccaagcaaatggaaaacaaaaaaaggcaggggttgcaatcctagtctctgataaaacagattttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctgcaccaagcggacctaatagacatctacagaactctccaccccaaatcaacagaatatacattcttttcagcaccacaccacacctattccaaaattgaccacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaagatcaacaaaattgatagaccgctagcaagactaataaagaagaaaagagagaagaatcaaatagacgcaataaaaaatgatacaggggatatcaccaccgatcccacagaaatacaaactaccgtcagagaatactataaacacctctacgcaaataaactagaaaatctagaagaaatggataaattcctcgacacgtacactctcccaagactaaaccaggaagaagttgaatctctgaatagaccaataacaggctctgaaattgaggcaataatcaatagcttaccaaccaaaaaaagtccgggaccagatggattcacagccgaattctaccagaggtacaaggaggagctggtaccattccttctgaaactattccaatcaatagaaaaagagggaatcctccctaactcattttatgaggccagcatcatcctgataccaaagcctggcagagacacaacaaaaaaagagaattttagaccaatatccttgatgaacatcgatgcaaaaatcctcaataaaatactggcaaaccgaatccagcagcacatcaaaaagcttatccaccatgatcaagtgggcttcatccctgggatgcaaggctggttcaacatacgcaaatcaataaacgtaatccagcatataaacagaaccaaagacaaaaaccacatgattatctcaatagatgcagaaaaggcctttgacaaaattcaacaacgcttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacgctacctgacttcaaactatactacaaggctacggtaaccaaaacagcatggtactggtaccaaaacagagatatagaccaatggaacagaacagagccctcagaaataatgccgcatatctacaactatccgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcaataccattcaggacataggcatgggcaaggacttcatgtctaaaacaccaaaagcaatggcaacaaaagccaaaattgacaaacgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcatcatca

SEQ ID NO: 60 - DNA, 1883 bp, Homo sapiens
  repeat_region (1)..(1883): l180_5
  misc_feature: n is a, c, g or t
  ref <301>: AUTHORS: Jurka, J; Walichiewicz, J; Milosavljevic, A
  ref <302>: TITLE: Prototypic sequences for human repetitive DNAPrototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tttttttcccaagatggcggattagaggcttttagtatgcctcagccacttggaaatggnaaaatagtgcataaagatcaactctgtgagctttaattcaagaaggaaaatgggaatccaccataatcgtgaaggacaccccagatcctagggaggagaatgtnggcaaacagcccctatgatggcgtccagctgataaaagtgagtgaagccccagtacgcgagagaggcagagagtctccctctgtgactcacttttccactggggatccgagcaacccaggccaagggagaacactttgtttctcccaagccctggagctaacgtggggagaggcttggagatgctgtgagggaaagacaccgggaaaagctgcagacattttcccagacctaggamcaagagcaggatgccatttttaatccgggcgcatacaaagtcagccattctttggcgacccggcagcgtggccgcgcaggcattttagtctcaggccagagattggagcgcctgctctggagtagggtaggggcctccacagccagaactgtgaaaagcgcctcagcagtaggcgctggaattgtgctctcccctactgcaagcctggggcgggaggagagctgctacagctgcagtttctcctgggcggcgagacttgcagccagggccagcttggcgacctggaactggtctgtgtgtgccattgctgggtgccccagcctgctcccctgagatcgtggtgcagsggggccctctctgctccacgcccaggcagatctccaggcattcagagcacccgctcgcctggwtcagcagcctgagccgccccacccttcctgkgcatagatcgtggtgcagsggggccctctctgctccacgcccaggcagatctccaggcattcagagcacccgctcgcctggwtcagcagcctgagccgccccacccttcctgkgcatagatcgtggtgcagsggggccctctctgctccacgcccaggcagatctccaggcattcagagcacccgctcgcctggwtcagcagcctgagccgccccacccttcctgkgcatagatcgtggtgcagsggggccctctctgctccacgcccaggcagatctccaggcatctggagcacccactctcctggattaggagtttaagccgccccacccttcccgtgcagagaacttggggctgaggaggtttccctgctccacgcctaggcacacctctgggcgcttggtggctgcccactggattctcccttggcgctggcgcttgtgcccgccatgggagatctgtaggcggacctgcctagtccggccccacccatcttggmccccgcccctccagggctgagcagrsagttcagancactntgcattccatgcatcagcccattkcctgaggcaacagagagcttctnccagtaaacaaggatcaaatatatacccagccacactggccgtagctagctcttacctataagcgccatctactggcttgtaggtcaaactgcacwgcccaatataaaacctgctaaaagaagtgcatagggctatagaagcaaagccaaaagaccatacccagcattctctacagtcacaccmcctagggaggaggagaaaggaaagggaaagaaaaaacaccaataatattatagggaaagaaagaaaagaaaaaaccctactcncatggaaataattacaaaaattagaagtgccagnatctccagatgagaaggaaccagcacaagaattntggcaccatgaaaaatctgaatgtagtgacaccaccaaaggatcgcactagctctccagcaatggttcctaatcaaaacggaaactcagaaatgacaggcaaagaattcaaagcatggatt

SEQ ID NO: 61 - DNA, 2890 bp, Homo sapiens
  repeat_region (1)..(2890): l1m2_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caaagaaatgtatktatgcaggagggcttcaagatggctgactagaggcakccggtactcgcctcctccacaaagaagaaccaaaatagcgagtagataatcacacttcgaatagakcatctaagagagaacactggaattcaacagagaagcgacaggaaacacctaaagcaaggaaggagaaggaagcgaggcagcctgctcggccgggattggctgggagccaggagaggctccccaatgcggggaaagggtaagtgagagacccccagcggtccacattcccaccacggactcctgcaatcctagccacgagagagcccctcaaccctcgcgggccctgagactaacatagggagctgcctggagwccgcgcganggcattgctccagagagggagctcacgctgggtcccacamacccccaagwcctaagcagctgcagcacggcgccattttgagagcccagccmccaccagactgcatcctgccctggggcccaacagcccctgcatctccacattcctggagccccastgacatnccccacccatggctgcagctgctggggcaraggcaggaaccactggcagcaancccwcccctgcccagcagaggggtggccatacaatttcatryacaccaaggacaaattcccctgmctgcaaatgctaccactgngagctgctgtggagctgaggyacgagcaatgcacncgctacccaggcgcctgcctatggctgctnccacwgaaagcaaccccaccctccccagcagcagggccacagtgcagccactgctgccctccacctgagcattccaccaggggcctggggatcaccctgcccctgcctaccacagccggcgcctgcacacaccaccggggggcctgaggacaggcctgcccggcccagctctgccacacccmccagtgcccaagcacgccatctaggggcctggggatcgcccaacccagtccaccaccgctggcacctgagcactcctcctgggggcctgaggacgggcctactcagcctgccactaccaccacagctggcacccacccacatgcgccacctgsrggcctggggactggcccgcccagcccgtcgcagccactgccaacaccaacacgcactgcttgggacccagagggttgtcccaccactgctactgccatcgcccatgccatgcyngctgcccaggggctcaagaacctgtccacccacccggcccaccgctgccactactggcacccaagcaagccacctggaggcccaagaatcggcctgcctggacccgctaacaccagtgccaatatatgccaccctggggcccaaggacaggcacactcagcccactantgccaccactggggcctgaagactggcccacctggcatcccagtccccagcaaaacttcaccacagcctccactaacaaccacaccctaagccactgaggaaatcacagacaccactgatgctgtttacagccaaagaaatcatacggagactacactactgcacgcacccagaatcaaagccaaagcgccctacccaaccaacaccatagatacatctwcaggaaaaagtccttccctacgaaagctamtccataaaattggaagaagcgactgttacaccagatgtgcagatatcaacgtaaggacacaagaaacatgaaaaagcaaggaaacatgacacctccaaaggaacacaataattctccagtaayagactccaawnaaaaagaaatctatgaaatcccmgawaaakaattcaaaatgatgatattaaagaagctcagtgagatacaagagaacwcagawaaacaatacaaggaaatcaggaaaacaattcakgatatgaatgagaaatttaccaaagagatagatatcataaaaaagaaccaaacagaaatcctggaactgaagaattcawtgaatgaaatamaaaatacatttgaaagcttcaanaatagactagatcaagcagaagaaagaatctcagaacttgaagacaggtcttttgaaataacccagtcagannnwaaaaaawaanaataaaaaagaatgaasaaagcctatgtgacatatgggacacmattaagcgaacaaatatttaaattwtgggwgttccagaagaagaagagntgggnaaaggcnyagaaaacctatttaataaaataatagctgaaaacttcccaggtttagcaagagattnagacatccagatacaggaggctcanagatccccaaatagatncaacgcnaaaagggcctctccamggcacattatagtcaaactgtcaaaagtcaaagacaaagaganaattctaaaaacagcaagagaraagcatctagtcacatataagggaatccccatcagactaacagtggatttctcagcagaaaccttacaggccaggagagaatgggatgacatattcaaagtgctgaaagaaaaagcaaaactgccagccaagaatactatacccagcaaagttatccttcaaaaatgaaggagaaataaagtctttcccagacaagcaaawamtgagggaattcgtcaccactagaccggccctacaagaaatgctcaagggagtcctamacctggaagcaaaaggacgatatctaccatcatgaaaacayacaaaagyataaaactcactggtagagcaawcacacaaakgagaaagagaaaggaatcaaatgktaccactacagaaawccaccaaaccacaaaganaaacaatgagaggaaacaaaagatatacaaaacaaccagaaaacaattaacaatatgacaggaacaagwcctcacatatcaataataaccttaaacgtaaatggattaaatttcccacttaaaagatanagactggct

SEQ ID NO: 62 - DNA, 3806 bp, Homo sapiens
  repeat_region (1)..(3806): l1m3_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
agagcaagatggcagaacagaatgctcnaacaattgcccccatyctryyccnccacaggaacaccaaattgaacaactatctacacaaaawagcaccttcataagaaccaaaaatcanntaagcgatcacagtacctggttttaacttcatatnactgaaagaggcactgaagagggtaggaaagacagtcttgaatcgccaacgccgcccctcccccatcccccggcagtggccgcacggcacggagagagaatccgcgcacttgggngagggagagcgcagcgattgtgggactttgcgttggaantcagtgctgccctgtcanagcggaaagcaacancgggcagaactcagccggcgctcatagagggancatttagaccagccctagncagaggggaatcacccatcccagcggtcggaacctaagttccggcaagcctcgccaccgtgggctaaagtgcnntagggtcctaaataaacttgaaaggcagtctaggccacaaggactgcaattcctgggcaagtcctggtgctgtgccgagctaagagtcagtggacttagggggcacacgacctagtgagacacyagccggggtggccaagggantgcttgcgccacccyctcccycaacnccaggcagcacaactcgcagctccgggagagactccttccctccgcttnaggagaggagagggaagagtaaagaggactttntcttgcaantcggataccagctcagccatagtaggatagggcaccgagcagagtnnwgaggycccnattctaggccctagctcccggatgacatttctaaacacaccctgggccagaagggaanctgctgccttaaagggaagganccagtcctagcaggantcatcacctgctgactaaagagcccttgggccctgaataatcagcagcgatacccaggttagyactcgccgtaggccttgggtgagantctgagacgtgctggnttcaggtgtgacncagcacattcccagctgtggtggctacggggagagactccttctgcttgagaaaaggagagggaanagtaaaggggactttgtcttgcagcttagntaccagcttggccacagtggagtagagcaccaagcgggctcttagggtccccgattccaggccttggctgttggatggcatttctggacctgccctgggccagaggagagcccactgccctgaagggagagtctcaggcctggcagcattcaccgcaagctgacagaagagtccttgggctttaagtgaacattkgcgrtagycaggcagtacttnctgtgggcctgcggcggtggtngccatagggagagnctcctctgcttgtngaaaggggagggaagagtgggaagaactttgtcttgtggcttgagtgccagctcagccgcagtagaacagagcaccgggtagatttctaaggtttccgactccaggccctggctcctggatagcatcyctggacgtgcccggggccagagagaactcaccaccctgaagggaaggatacaagnctggctggctttaccacctgctgattgtagagtcccggggccttgagcgaacataagcagcggccaggcagtggttactgcgggccttgggcgagacccagtgctgtgctggcttcaggtctgaccyagtacagtcycagtgrtggtggccacaggggtgcttgtgtcacccctccyccagctccaggcagctcagcacagagagagagacngagtttgtttgrgggaaagtaarggaagagaacaagagtctctgcctggtaatccagrgaattcttccagatcttatccaagaccacnaaggcagtacctctacgagtctgcaagagccacagtattactgggcttggggtgccccctaatgcagatacggccgcagtgacaaaaaacttagatcacaacacycaagtcccttcaaatacctggaaagcyttcccaagaaggacgggtacaaacaagcccagactgtgaagactacaataaatacctaactcttcaatgcccagacacagacaaacatctacaagcatcaacaccatccaggaaaacatgacctcaccaaatgaactaaataaggcaccagggaccaatcccggagaracagagatatgtgacctttcagacagagaattcaaaatagctgttttgaggaaactcaangaaattcaagataacacagasaaggaattcagaatyctatcagataaatttaacaaagagattgaaataattaaaaagaatcaagcagaaattctggagctgaaaaatgcaattgacatactgaagaatgcatcagagtytcttaacagcagaattgatcargcagaagaaagaattagtgagcttgaagacaggctatttgaaaatacgcngycagaggagacaaaagaaaaaagaaaanaatgaagcatgcctacaagatctagaaaatagcctcaaaagggcaaatctaagagttagtgaccttaaanaggaggtagagagagagataggggtraaagtttattcaaagcnataataacagagaatgtcccaaacctagagaaagatatcaatattcaagtaaaagaagnttatagaataccaagcanatttaacncaaagaagactacctcaagacatttawtaatcaaactcccaaaggtcaaggataaagaaaggatcctaaaagcagcaagagaaaagaaacaaataacatacaatggagcnccgatatagtctggcagcagacttntcggcggaaancttacaggccaggagagagcggcatgacatatttaaagtgctgaagaaaaaaaaaaaaactttnatcctagantagcgtntccagngaaaatatccttcaaacatgaargagaaataaagactttcccagacaaacaaaagctgagggatttcntcaacaccagacctgtcctacaagaaatgctanagngaattcttcaatgtgaaagaaaaggacgttaatgannaataanaaatyatctgnaggtrcaaaactcactgataatagtgcgcagaaaaacanaatattataacantgtaattatggtgtataaactactcttragtagaaagactaaaagatgaaccaatcaaaaatantaactanaacaacttttcaagacatagacagtacnntaagatanaaatagaaacaacaaaaagtttaaaaattggnggacgaagttaaaatgtagagtttttattagttttcttnttgttnnttgrtttttttnaanttatgtaatnagtgttattatcagtttaaaatataggatattatttgcaagcctcatggtaacctcaaatcnaaaaacatacaacggatacacaaaaataaaaagcaagaaattaaaacatatcaccagagaaaatcaccttcactaaaaggaagacaggaaggaaggaaagaanaaagagaagaccacaaaacaaccagaaaacaaataasaaaatggcaggagnaagtcattacttatcaataataacattgaatgtaaatggactaaactctccaatcaaaagacatagagtggctgaatggatataaaaataagacccaatgatcggtcgcctanawgwaacacacttcacctataaagacacakatagactgaaaataaagggatgaaaaaagatatttcatgcnaatggaaaccaaaaaagagnaggagtagctatacttayatcaganaaaatatatttcaagacgaaaactataagaagagacaaagaaggtcactatataatgataaaggag

SEQ ID NO: 63 - DNA, 1765 bp, Homo sapiens
  repeat_region (1)..(1765): l1m3a_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gagtgawgtcagcaagatggcagaatwggaggtctcaggctccagtctccctcacagaaagtccgactagcaactattcacagacaagaacgcctttgtgaaaaatgccagaacttggaaatgagrctgagacanctncgtggancacagaaacgaataaaaaccacattaaaagggtaagaggaaccgtctcactttaaccacgttgcccctmagtcggcacagtrccacacngagagaawttccccgggcctacagtttctacagtgggaaaagagagctkgaggtggacatccagcttccctagcattccaagatgcttcccaggargcccactcynatctcacctcatgaggaaacactgagggaaatggcanggctagaccgtctggagtcaggtagaaacaaaaaaagggggcanagctcatagtaaccagtgcacggatcttggtggtagctctgtattcctgccagcggtggcgcctgatcagaggtaccagccaatggcatagcccacccgcaaagctgagctggtcgctcccagaagcacggtgagaagttcnacccggcttgagtccctagatggccagcctccaaacccagccttagascctaccccagngctccacccaggcagggagatacacaccacmatgtatttcagcagagcacagaggctagacctgcctgacccaggagcccaaacagtgactcggcccagcctcaaagcccaccccaaggacccacacaggcaggaaggcaaacgcggattgtgcakctctaccagggcaaagtgccagccaccgtccattcstwncagcaattccatctaaccttgcagcctaggggctggccctgcccaactgcagagctsaaacagcggctccgcctggccasagagtmtaccccgtggcycagcccaatagacgcgactncaacgtccantcagcggctccgcctaannncagagcccagccagcagccccgcctgacctcagagcmcaggcantagcccgnccagctagagaacccaamagcaagcactgcctacccatggttattaccagctgtcccatccagaatcacaagctggactgaataatgaaggtctwttcctgncgaagaacacctgtaaaagccagaagaggtggctgcctmgtcaaatgcatggataccaatgcaaggacgcaagggttacgaagaatcaaagaatcatgacacctccaaaataaactaacaaagctccaacaatggamcctaaagaaataaagatctataaaatgactggcaaagaattcagaataatcctcttaaagaagttcggtgagctacaagaatacatagatagaaaattaaataaaatttggaaaacaatacatgaamaaaacgaaaagtttgacaaagaaatagaaacgawtattctaaaacccaaatagaaatcctagagatgaagaacacaattgctgaacaaaaaaattcaataaaaagcttcgacagcagactcaatcaagcagaagaaagaatcagtgagctcgaagacagaacatttgaaattatccagtmagaggatcaaaaataaaaaaaatgaaaaacagtgaagaaagcctataggaattatgggacaccatcaagaaaactaacatacgcataatagaaatnccagaaggagaagagaaagaaggccagaaagyatattttaagaaataatgactgaaaacttcccaaatctggggaaagatgccagcatccaggtacaagaagcaca

SEQ ID NO: 64 - DNA, 1175 bp, Homo sapiens
  repeat_region (1)..(1175): l1m3b_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ggagtgagaacagcaagatggcagaataggaggtcccccactcatattccctcacagcaacaataatttggcagtcatccacgaacaaaagtgcctttgtgggagctttgggatccaggtaggaggttgcgaaacccwggtggagcccaagaccaaggaggacnatttgagaaggcaggcctgtgaccagatggcaggcttgctgatcatggtcttggctacagacccagaaacaktgctgtmcccctgtggactcagctacagcccyaattggccttggtcctgccaccmrmamcatmctccaaganacccaggaggagccatacccacccatgcctcgggtaacaggcccgccaanctcggtcctggctgtggaycctgaagcggcccatgacccagctccatcccctctcagmtgtggtcaggagccagtcctgcncgcccagggacccgcccagtgacctggnaagagcattcccagggantcagcaggagccacacccacacatatacctggtawcaggtctaccacgtgcagaaccaactgcagatcctgaagcagccctgtaactcagttccagctctacccaaccaaggttctgaatgtagtcctgcctatccaaagattcggcaagaggcatacccatccgtgctactggaggcaggcttgccaacctcagtctsactgtggatcntgaagyagcagccatgtgacccggctccaaccccaytyaactgcgatcccagtggmaatctcatcagcccagggatctracaggagaaggtcttcctcccaaaaccagtctgtaawgactgaaagaggtgtttgytccttcaaatgcacggacatcaacataaggctacacagatwataaagaatcaggcaaacatrmcaccaccaaaggaaactaawaaagttccagtaaccaaccccaaagaaacggagatctawaaattacctgacaaagaattcaaaataatcatcttaaagaakctcaatgagatgcaagagaacacagatakacaactaaanaaaatcaggaaaacaatkcatgaacaaaatgagaagtttaacaaagaaatagaaaccataaaaaagaaccaaatagaaatcctggarctgaagaatacaatgaaagaaataaaaaattctatagaaagctttaacaggagac

SEQ ID NO: 65 - DNA, 1625 bp, Homo sapiens
  repeat_region (1)..(1625): l1m3c_5
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gagtgatgtcagcaagatggcagaataggaggtctcagccctatccccccacagaaacaccgattttgacgaatacmcacggatgagagtacctttgwgggagtccgggagtccagtggacaagttccagcacaccgttggagwaaaaaatctaagaatagatgcattgaagagggtaagaagaacagtttcactttacccacgtcacccctcccccaaggtggcatagctcagtgccaagagagwctcctttggtccgcgatttctcccgcaggggaaagtgagagcatagtgagtgagcgtccggctcccccagccatgcgggacgctgcccaggaggcccacttttttctcaccccacccagaacactgaggkgatcggcatggctgagtggttgggagaggctgaaagcagggaagagangmtggggactcacagcagccagggcatggaactcaacmaaaggccacagatcctactaactgcttcgcggactccatcaggaagcccgcccacaagcttcwtgggatacgttgcctgcagacccccccagctggcccacgggcgcccccaacgctctgtatgcctcacccctggcttcggcatggctcccaagtgcactcctgtggacagcgagtgcaagcctctgcagatggcttacgagcacgcgcagacagccggcttgactctgcwgwattggaagaagstacacaaacttgagcatttcagggcaccgccctaggaaaaagaaacggaagcctctttgcactcggcctggctttgcaggattgagagaaganatacaatcttatctgcacctagcmtggctttgtgggattgagagaaggcatacaatcctaagacttacctcctcctcargagggaacaagaggwgtggagtgggyacatcmatagaaaaggtctgagagagycccagaatccctagccaggctggttggtgaaggtctttctcttctgaagccagtcagtaaagactggaggaggtgactgtttcttcaaatgtgaagacagcaatgcaagactttaagaaacatgaaaaatcaaggaaacatgacantaccaaaggaacataataattttccagtaaccgaccctaaagaaatggagatctacaaattgcctggcaaataattcaaaataatcgttttaaggaagctcagtgagctacaagaaaacacagatagacaactcaacaaaatcaggaaaacaatacatgaacaaaatgagaagttcgacaaagatatagaaatcgtaaaaaagaaccaaacagaaattctggagctgaagaatacaatgactgaacaaaaaaatgcaatagagagcwtcaacagcagactcgatcaagcagaagaaagaatcagcgagctcaaagacaggtcatttgaaattatccagtcagaggatcaaaaaaaaaaaaaatgaaaaagagtgaagaaagcctgtgggatttatgggacaccatcaagagaaccaatatacgcatcatggaaatcccagaaggagaagagagagagaaaggggcagaaagcttatttaaagaaataataactgaaaacttcccaaatctggggagagatatggacatccaggtacaagaagcaca

SEQ ID NO: 66 - DNA, 1375 bp, Homo sapiens
  repeat_region (1)..(1375): l1m3d_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gagtgacatcagcaagatggcataataggaagccctggacctttcttcccttcacagacacactgattcagcaacaattcacggaaaattacctttgtgagaaatgcagaaactagttgagaggctcctgcaccctgggcgagcgcgaaaccagacccacatcaaagccggtagggagattcaggacaccctctcatcgaagtccctccccccggcwcagcgcmgtgcgatcggaaggaaaaaacccccaactcccggcttctcccaggggaggaaaagagttggttcgcacgtcaagtgccccracttttccgaggggctacccagaggactgtcttctgtcttgccwgtctcrgagctctgataggcccggcataatctagacacccgggggagaacagagatggtggtttgggctggtagatgccatagctnctcacccctgctcagcacagaacaagnagatgaaaacccccagntctcagctttcccctgaggaggaaaanagttgaatggactggaaaacagaattgaatggagcatccaacaatccagctttctgggagtgcctaaggaaccgattgcatttcaacttgtcgcgctacgctgatangattnancataccctanatgctcggcgactgcaaagaacaaaaancaggttggactagtacgaaggtttgagaggnccccaaaatctctggctaggctgatcggtgaaggtcttctcctgcataaggccagtctgtgaagactgagagaggtggctgctttgtataatgcgcagacaccaatacagagagtcaaggaaaataaagaatcagggaaanatgttccaaacaaaggaacaggataattttccagaaactgaccctaataaattggagttatanaatttacctgacgaagaattcaaaacaattgttntaaagatgctcatgaataacatgataaagatgctcaccaagatcaggaaaacaatacatgaacaaagtgagaatttcaacaaagagatagaaaatgttaaaaagtaccaaacaaaaatcatggagctgaagaatacaataactgaactgaaaaattcactagagaggttcaacagcagactagatcaagcagaagaaaggatcagtgaactcaangacaggtcattcgaaattatcgagtcagaggagcaaaaagaaaaaagaatgaaaaagagtgaagaaagcctaagggatttatgggacaccatcaagngaaccaanatacacatcatggaagtcccggaaggagaagagagaganaaaggnccagaaagcntattcgaagaaatagtgactgaaaacttcccaaatctggggaaagaaatggacatccagatncaagaagccca

SEQ ID NO: 67 - DNA, 600 bp, Homo sapiens
  repeat_region (1)..(600): l1m3de_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gcacacttttccagcwgctgcctgagggtctggcttctaactagcctgcatctgggagctgatagggcagataaacaatagacctccaggagcctgaacaggaggttggcacttcccatgccttctccccagctcactccagtgataaatccaggtctacagattctccctggaaggagtttgtccacacatcaagcgccccaacttttatagcttccacccaagggactggctcctaaatcacctagctctgggagttgatggggctttgcatttatgagtctccctagaccacagagaacaaagaggtggttttaaaacaggcacacttccagcagctatctccccaggatcagagggtgcagcctgaacatgagtacaggnatttgccacagatcctctccctggcttagtgcagagagagtgggagataaacacccatgctcagcttcaccstgaagatagaagaaactggaacatacatccaacaccctaacctttccagctacatctagagagtctggtttctaccttacctgtctyagagtactracaggatatggcacatcctaatctccagggggccaccaaaaacanaga

SEQ ID NO: 68 - DNA, 750 bp, Homo sapiens
  repeat_region (1)..(750): l1m3e_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gagtgatgtnaccaaaggtagaatagaagcaagctggcttcactccccccacccacagaaaaccaaaaacaaatatacagcaccaagattatcaccagcaatatcccagaactcaaatatgaggatgagacagttcctgaggccacagagaagtaaaaaactctgagcagayagtaagagaattagacttcnatatcnacratgcccctcccccaatctgcccagcaccacatanaaaanttctcccagactcanagtttctacaytggaaaaagtgagattraggtggacaaccagcttccccaccatcttgggttccttggcaggagacctgtccctgcctcaacccatrggaagcatcaygagtgcctgaagggagaaatatycctgaggacagccagagacaaagggaggaggtaggactaccatccccagccctggaaactcggggggctgctctgtaacttggmcaaaggagacaccaaatcagagtggctgttcagcagcaccatgctgtaggaggttcnttccacaggtcccctggrcatgaacccctagccagccttcccacactgccaggatatcccctttgggacctcccccaatccgggatgggnagcactctgagagccaaggcaaacctrggcttaaggtgccatctagtgcygaaaggaggcagngacctagygaaaagaaattcaacaggtaaattacaaagaatctctaagcaaacaaaacaaaccagmcaga

SEQ ID NO: 69 - DNA, 1165 bp, Homo sapiens
  repeat_region (1)..(1165): l1m5_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aaagagtttcacttctagaatggcagtgtgaggagctccatagacccactccccagtgaaacaaccataactggtgaaaattatttttaaaaanncaaccatttaaagtctctggaaattgtcctaagggcatacagcaaatgaaacatttattcaagaaaatctactaaatcttagtaagaacagtgagagtctgtggtatttgagccatgactgtctcccttcttcccccccccnasccagctcagcawgatagaaactccactccaggtkggtgcagccaagaacacagggctccctctcccctcagctcccagtcaagggctatggtatctncctaggaggagcaggacatcagcatttctcatcccccccagctccatgttgcagaggctaaattccaggtgagtgtagctgagaggtcgggggctcccttcctccacccagcccccactcataggatggacttggctctaccngccaggtatggcaggctgagaatactggggccctaattacccttaccccagctcgctcatagggnagaggttccatgccaggagaggcaagccaagaagaccagaggctactrncccnncccagcacccagagcagtggctcagagattttgcccagggggagaggcaggccataagaacagagagctccaaagctctccccaaaggaactgactttatttgcaacagagtgtgaggaagttcaagcctaagggcactctcaaaaacaatggagattttggtggtaagcaattaagggaggctggtagctcnannanagyaacaagctaaaccataggccagctagtttaccagagagaaccagggaaagagacagctaagaagagccctcctggggtcagaacaaacctcaaacactgacctcaaaaaactacccctgcctraatttaattggatcagactgtggagcaatttatgccccagggattgttgaaaaacaatagagcaatcagccagcaattagtggagcctaacagctgggtgtgantacmnamngaggcagacagcttaacagagagatcagagaaagagacagtcaaagagagccctgctaaaaccactgtcatcccagggtgactgtgcacatgcccaaggctgtgccctctgaggagcaacatcagaggctt

SEQ ID NO: 70 - DNA, 2113 bp, Homo sapiens
  repeat_region (1)..(2113): l1m6_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gacatcagcaagatggcggaataggactttccagcgctcgtcctcacagaaacatcaatttgaacaactatccacgcacgaaaataccttcacaagagctaaggaaaccaggtgagagattacagyacctgggtgtagcacagaaataagaaaagacgcattgaagagggtaggaaggacagttttacattacccgcgtcacccctcccccaancccaggcagcacagcatggagagagataccctctgcttgggggaaggagagggaagtgagcacaggactttgccttggaccccaaacactaggcccgccccagtaaaacccagtactaggcaggcccccatagccccagactccaggccagtacctacggactgagccgyaccagatcccacagcccaggctccaggcctgcctggtggactcagtctccaggcctgccccagcaccaggccaaccccagtgccccaggctccagaccggccccagcaccaggccagccccagtagccccaggctccaggctgsccccagcaccaggctggcccccatagccccaggcttcaggcccaccccagcaccaggctggcccctrcagccctagtcatcaggccagcacctatagacccagcctccaggctggcccctgtagacacaggctccaggcctacccagcrccaggccagcccctgtagccccaggctccaggcccaccccaggytccagaccagcccagagccaggtyggcccacatagccccaggcttcaggcctgccccagyaccaggtcagcacccctggcctcagaccttagccaggtaccaggctggcacctgtagacacaggctccaggcctgcccagtaccaggccagtccctgtggccccaccctccagggcyagcccctgtggccccatgctccagcagacccagggttcaggcctgtcccagtagaccccagcactaggctagtccccatagacccaggctccaggactgtccctgtgtacccaggtcccagggcagcccctatggccccaggacccaggccagccctcagagacctagcctctaggccagccctgcagacccagcctccaggctggcacccayagacccaagctccaggccatcccccaggttccaggccagcctcagtagctccaggcaccaggctagcacccacagacccaggctccagactagccccacgctaccccagcaccaggccagccccaggctccaggctggtccctgtggcccaggctccagtggacccagggtccaggcctgctccagcagacccagggtccaggcccaccccagtagaccctggttccaggctagcccccatggactcaggctccaggaccacccctgcagacccaggctccaggccagccccyatggaccaggatccarggcccatytccccagttgcaggctccaggcctgccccagtgccaggccagcccccatggactcaggctccaggcccatcccagtggacccaggctccaggcccatcccagyaccaggccagcccctgyagactcaggctcaaggcccaccccagcaccaggtcagcccctgtggacccaggcttcaggccagcccctatagacacaggctccaggccyaccctcatggacccaggctccaggcccayccccacagacccaatcaacaggtccacccagtggatccaggctccaggcycaaccctgtggacccaggcaccaggcctgccacctgctgacccaggcaccaggccagcctgcctaaggactccagcagcaagcctgcctatagaccataccagatggcctgcccagaatctctggatgactggtgaagggctttcccagacaaagccagtctgcaaagactggaataagtccctacttcttcaaatgtgcagacaccaatgcaaggcccaagaatcawgaacaatcagggaaacatgacaccaccaaaggaacaaaataaatttccagtaactgaccctaaagaaatggagatctatgaactgcctgacaaagaattcaaaataattgttttaaggaagctcagtgaactwcaagaaaacacagatagacaattaaatgaaatcag

SEQ ID NO: 71 - DNA, 587 bp, Homo sapiens
  repeat_region (1)..(587): l1m7_5
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgcaaggtgaaatgaaaggacactagacagtaacttgaagccgtatgaagaaataaagatctcagtaaaggtaaatacatgggcaattataaaagctagtattattgtaacwatggtttgtaactccactttttgttttctacatgatttaaragactaatacattttttaaaaattattagtctaaaagctagtattattgtaattttggtttgtaactccattttgttttctacataatttaaaagactaatacattaaaaataattattaatttatgtttttgggcacacaatgtataaagatgtaattttgtgacatcaataactgaaaggggtggggayagagctgtaaaggcagagtttttgtatgttattgaagttaagttggtataaattcaaattagattgttataactttaggatgttaaatgtaatccccatggtaaccacaaagaaaatagctatagaatatacacaaaaggaaatgagaagggaattaaaatatttcactacaaaaaaaatcaactaaacacaaaagaagacagtaatggaggaaatgagggacaaaaaagctataaggcatat

SEQ ID NO: 72 - DNA, 1069 bp, Homo sapiens
  repeat_region (1)..(1069): l1ma10
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttaatatccaaaatatataaggaactcaaacaactcaacaagaaraaaacaaataacccaattaaaaaatgggcaaargacctgaatagacatttytcaaaagaagacatacaaatggccaacagatatatgaaaaaatgctcaacatcactaatcatcaaggaaatgcaaattaaaaccacaatgagatatcacctcacacctgttagaatggctattatcaaaaagacagaaaataataaatgttggygaggatgtggagaaaagggaactattgtacactgttggtgggaatgtaaattagtayagccaytatggaaaacagtatggaggttcctcaaaaaaytaaaaataraactaccatatgatycagcaatcccactwctgggtatatatccaaargaattgaaatcagtatgtygaagagatayctgcactcccatgtttaytgcagcaytattcacaatagccaagatatggaawcaacctaagtgtccatcaayggawgaatggataaagaaaatgtggtatatatacacaatggaatactattcagccataaaaaagaatgaaatcctgtcatttgyarcaacatggatgaacctggaggacattatgctaagtgaaataagccaggcacagaaagacaaatactgcatgattccacttatatgaggtatctaaaatagtcaaactcatagaagcagagagtagaatggtggttgccaggggctgggggragggggaaatggggagttgctgttcaatgggtataaagtttcagttatgcaagatgaataagttctagagatctgctgtacaacattgtgcctatagttaataatactggattgtacacttaaaawttgttaaaagrgtagatctcatgttaagtgttcttatcgcacaacaaaaaaatggggaacttttggrrgtgatggatatgttcattatcttgattgtggtgatggtwtcacgggtgtntacatatgtcaaaactcatcaaattgtacacwttaaatatatgcagtttttagtgtataattatacctcaacaaagctgttttaa

SEQ ID NO: 73 - DNA, 1055 bp, Homo sapiens
  repeat_region (1)..(1055): l1ma2
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ytaatatccagaatmtataaggaactcaaacaaatcaacaagaaaaaaacaaataatccmattaaaaartgggcaaaagacatgaayagacatttctcaaaagaagacatacaaatggccaacargyatatgaaaaaatgctcaacatcactaatcatcagagaaatgcaaatcaaaacyacaatgagatatcatctcaccccagttaraatggcttttattaaaaagacaaaaaataacaratgctggygaggatgtggagaaaagggaactcttayayactgttggtgggaatgtaaattagtacarccaytatggaaaacagtttggagrttyctcaaaaaactaaaaatagarctaccatatratccagcaatcccactrctgggtatatayccaaaagaaaggaaatcagtatatyaaaragatacctgcactcccatgtttattgcagcactattcacaatagchaagatttggaatcaacctaagtgtccatcaacrgatgaatggataaagaaaatgtggtacatatacacaatggagtactattcagccataaaaaagaatgaratcytgtcatttgcagcaacatggatggaactggaggtcattatgttaagtgaaataagycargmacaraaagacaaacaytgcatgttctcacttatttgtgggatctaaaaatcaaaacaattgaactcatggagatagagagtagaaggatggttaccagaggctgggaagggtagtnggaggattggggggnggkgrrgagggatggttaatgggtacaaaaaaatagttagaaagaatgaataagacctagtatttgatagcacaacaaggtgactatagtcaataataatttaattgtacattttaaaataactaaaagagtataattggattgtttgtaacacaaaggataaatgcttgaggggatggataccccattttccatgatgtgattattacacattgcgtgcctgtatcaaaacatctcatgtaccccataaatatatacacctactatgtacccacaaaaattaaaa

SEQ ID NO: 74 - DNA, 1042 bp, Homo sapiens
  repeat_region (1)..(1042): l1ma5
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttaatatccaaaatatataaggaactcaaacaactcaacaagaaraaaacaaataacccaattaaaaaatgggcaaargacctgaatagacatttytcaaaagaagacatacaaatggccaacagatatatgaaaaaatgctcaacatcactaatcatcaaggaaatgcaaattaaaaccacaatgagatatcacctcacacctgttagaatggctattatcaaaaagacagaaaataataaatgttggygaggatgtggagaaaagggaactattgtacactgttggtgggaatgtaaattagtayagccaytatggaaaacagtatggaggttcctcaaaaaaytaaaaataraactaccatatgatycagcaatcccactwctgggtatatatccaaargaattgaaatcagtatgtygaagagatayctgcactcccatgtttaytgcagcaytattcacaatagccaagatatggaawcaacctaagtgtccatcaayggawgaatggataaagaaaatgtggtatatatacacaatggaatactattcagccataaaaaagaatgaaatcctgtcatttgyarcaacatggatgaacctggaggacattatgctaagtgaaataagccaggcacagaaagacaaataccgcatgttctcactcatatgtggaagctaaaaaagttgatctcatagaagtagagagtagaatagtggttactagaggctgggaagggtagggrgaggggggratagggagaggttggttaawggrtacaaaattacagttagataggaggaataagttctagtgttctgtagcaccgtagggtgactatagttaacaayaatttattgtatattttcaaatagctagaagagaggattttgaatgttcccaacacaaagaaatgataaatgtttgaggtgatggatatgctaattaccctgatttgatcattacacawtgtatacatgtatcgaaatatcacactgtaccccataaatatgtacaattattatgtgtcaattaaaaa

SEQ ID NO: 75 - DNA, 1053 bp, Homo sapiens
  repeat_region (1)..(1053): l1ma9
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttaatatccaaaatatataaggaactcaaacaactcaacaagaaraaaacaaataacccaattaaaaaatgggcaaargacctgaatagacatttytcaaaagaagacatacaaatggccaacagatatatgaaaaaatgctcaacatcactaatcatcaaggaaatgcaaattaaaaccacaatgagatatcacctcacacctgttagaatggctattatcaaaaagacagaaaataataaatgttggygaggatgtggagaaaagggaactattgtacactgttggtgggaatgtaaattagtayagccaytatggaaaacagtatggaggttcctcaaaaaaytaaaaataraactaccatatgatycagcaatcccactwctgggtatatatccaaargaattgaaatcagtatgtygaagagatayctgcactcccatgtttaytgcagcaytattcacaatagccaagatatggaawcaacctaagtgtccatcaayggawgaatggataaagaaaatgtggtatatatacacaatggaatactattcagccataaaaaagaatgaaatcctgtcatttgyarcaacatggatgaacctggaggacattatgctaagtgaaataagccaggcacagaaagacaaatactgcatgatctcacttatatgtggaatctaaaaaagtcaaaytcatagaaacagagagtagaatggtggttaccaggggctggggrakgggggaaatgggaagatgttggtcaaagggtacaaagttkcagttatgtargatgaataagttctrgagayctaatgtacagcatggtgactatagttaataatactgtattgtatacttgaaatttgctaagagagtagatyttaagtgttctcaccacanacaaatggtaactatgtgaggtgatggatatgttaattagcttgaytgtggtaatcatttcacaatgtatacatatatcaaaacatcacgttgtacaccttaaatatatacaatttttatttgtcaattatacctcaataaagctgraaa

SEQ ID NO: 76 - DNA, 932 bp, Homo sapiens
  repeat_region (1)..(932): l1mb3
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttaatatccaaaatatataaggaactcaaacaactcaacaagaaraaaacaaataacccaattaaaaaatgggcaaargacctgaatagacatttytcaaaagaagacatacaaatggccaacagatatatgaaaaaatgctcaacatcactaatcatcaaggaaatgcaaattaaaaccacaatgagatatcacctcacacctgttagaatggctattatcaaaaagacagaaaataataaatgttggygaggatgtggagaaaagggaactattgtacactgttggtgggaatgtaaattagtayagccaytatggaaaacagtatggaggttcctcaaaaaaytaaaaataraactaccatatgatycagcaatcccactwctgggtatatatccaaargaattgaaatcagtatgtygaagagatayctgcactcccatgtttaytgcagcaytattcacaatagccaagatatggaawcaacctaagtgtccatcaayggawgaatggataaagaaaatgtggtatatatacacaatggaatactattcagccataaaaaagaatgaaatcctgtcatttgyarcaacatggatgaacctggaggacattatgctaagtgaaataagccaggcacagaaagacaaatactgtatgattccacttatatgaggtacctagagtagtcaaattcatagagacagaaagtagaatggtggttgccaggggctggggggaggggggaatggggagttaktgtttaatgggtacagagtttcagtttgggaagatgaaaaagttctggagatggatggtggtgatggttgcacaacaatgtgaatgtacttaacgccactgaactgtacgcttaaaaatggttaaaatggtaaattttatgttatgtatattttaccacaattaaaaaaaaa

SEQ ID NO: 77 - DNA, 1711 bp, Homo sapiens
  repeat_region (1)..(1711): l1mb6_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ggtaatgtcagcgaaaatggcggagtaaggamctccgaaaattcactcctccataaaagcaatgaaaacactggcaaaaattgtcagaatcaactttttcagaactctggaaattaaccaaaggcttacagcaatctaggaagtgtttattcaagaaaaayagctgaatctcwgtaagaacagcgagctttgtggtattttaacttgccctantcccatcccccwctctccagctcagcagtagccttgaaaataacagcttatattatggtgaaaaccagcagccaccggagkgggcagaacgggtttggagcttctcaaaagycncattcccagggaattgtcattatttgacctgtctggcggctccctggaagactccattcamagggcttgtctttatttgacctgactcagagctcactcagtgcgaamagcattatacctgggggcatttgttgaaaacawttagaggcaawtgtttaacaccacagctgcctgaggcagtgrataacagttggggcaaacaagaggctgaccaaaaagcttaaaaggaaaagctggggaatgagatgtccgnaggggctttgaaaagctccaacatattcctgggaatctagaaggccacgcgcatgcccagggctgtacacatgctcagaaaagacctaagaaggccctaagctctcacctctggctgaccttgagactctgcacaagcaggaagtgaagactaaggcagagttgtaaactgcctggctgagtgttgaaggtatgccccaacacacacacagaaccccttggcaaagamtgggagacttgttggttcmaggcatttaaggaaatctctgtccaatcattagctgaccactaagctaacngagcagagacttcagtggccacacatgacaaagaatacagactttacaaaattagttcagaaaagtcactaaacaaacagcaacaanaacacaaaagagyaacaacaaaccctggaaaggagggagaatctgatttccagagttgccacattatattatttaaaatgtccagttttcaacaaaaaattacgaggcatacaaagaaacaagaaagtatggcccatacacaggaaaaaaagcagttaatagaaactatccctgaggaagcccagacgttggacttactagacaaagactttaaatcagctattwtaaatatgttcaaagaactaaaggaaaccatgtntaaagaantaaagaaaaatatragaacgatgtctcaccaaatagagaatatcaataaagagacaaaaattataaaaaataaancaaatagaaattctggagttgaaaagtacaataactgaaataaaaagttcactagaggggtacaacagcagatttgagcwggcagaagaaagaatcagcgaacttaaagataggtcaatcgagattattcagtctgaggaacaaagaaaaaagaatgaagaaaaatgaasagagcctcagagacctgtgggacaccatcaagcgtaccaatatatgcataatgggaatcccagaaggagaagagagaaarkggcagaaagaatatttaaagraatagtggccgaaaatttcccaaatttgatgaaaaacatywayctwcayatccaagaagctcaataamctccaagtaggataaactcaaagagatccacatttasatgcatcatagtcaaactgctgaaaaa

SEQ ID NO: 78 - DNA, 922 bp, Homo sapiens
  repeat_region (1)..(922): l1mb7
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cttgtatccagaatatataaagaactcttacaactcaacaataaaaaaacaaacaacccaattaaaaaatgggcaaaagatttgaatagacatttctccaaagaagatatacaaatggccaataagcacatgaaaagatgctcaacatcattagtcattagggaaatgcaaatcaaaaccacaatgagataccacttcacacccactaggatggctataattaaaaagacagacaataacaagtrttggcgaggatgtggagaaattrgaaccctcatacattgctggtgggaatgtaaaatggtgcagccactttggaaaayagtttggcagttcctcaaaaagttaaacatagaattaccatatgacccagcaattcyactcctaggtatatacccaagagaawtgaaaacatatgtccacacaaaaacttgtacacgaatgttcatagcagcattattcataatagccaaaaagtggaaacaacccaaatgtccatcaactgatgaatggataaacaaaatgtggtatatccatacaatggaatattattcagccataaaaaggaatgaagtactgatacatgctacaacatggatgaacctcgaaaacattatgctaagtgaaagaagccagacacaaaaggycacatattgtatgattccatttatatgaaatgtccagaataggcaaatccatagagacagaaagtagattagtggttgccaggggctgggggraaggggaaatggggagtgactgctaatgggtacggggtttctttttggggtgatgaaaatgttctaaaattagatagtggtgatggttgcacaactytgtgaatatactaaaaaccactgaattgtacactttaaaagggtgaattttatggtatgtgaattatatctcaataaarctataa

SEQ ID NO: 79 - DNA, 1077 bp, Homo sapiens
  repeat_region (1)..(1077)
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cttgtatccagaatatataaagaactcttaaaactcaacaataaaaaaacaaacaacccaattaaaaaatgggcaaaagatctgaatagacatctcaccaaagaagatatacagatggcaaataagcacatgaaaagatgctcaacatcatatgtcattagggaaatgcaaattaaaacaacaatgagataccactacacacctattagaatggctaaaatccaaaacactgacaacaccaaatgttggcgaggatgtggagcaacaggaactctcattcattgctggtgggaatgcaaaatggtacagccactttggaagacagtttggcagtttcttayaaarctaaacatactcttaccatatgatccagcaatcayactccttggtatttacccaaatgaattgaaaacttatgtccacacaaaaacctgcacacgaatgtttatagcagctttattcataattgccaaaacttggaaacaaccaagatgtccttcaataggtgaatggataaacaaactgtggtacatccatacaatggaatattattcagcgataaaaagaaatgaactatcgagacatgaaaagacatggaggaaccttaaatgcatattgctaagtgaaagaagccagtctgaaaaggctacatactgtatgattccaactatatgacattctgaaaaaggnaaaactatggagacaagtaaaaagatcagwgattnctagagkgastrggarrgggagggaagaataggtggagcncaggggatttttagggcagcgaaactattctgtatgatactataatggtggatacatgacattatacatttgtcaaaayccatagaactgtacaayacaaagagtgaaccctaatgtaaactatggactttagttaataataatgtatcaatgttggttcatcaattgtaacaaatgtaccacattaatgcaagatgttaataatagggtaaactrttgtgtgggggagggagtatatgggaactctctgtactttctgctcaatttttctgtaaacctaaaactgytctaaaaaataaagtctattaataa

SEQ ID NO: 80 - DNA, 2487 bp, Homo sapiens
  repeat_region (1)..(2487): l1mc3
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cttgtatccagaatatataaagaactcttaaaactcaacaataaaaaaacaaacaacccaattaaaaaatgggcaaaagatctgaatagacatctcaccaaagaagatatacagatggcaaataagcacatgaaaagatgctcaacatcatatgtcattagggaaatgcaaattaaaacaacaatgagataccactacacacctattagaatggctaaaatcaaaaacactgacaacaccaaatgttggcgaggatgtggagcaacaggaactctcattcattgctggtgggaatgcaaaatggtacagccactttggaagacagtttggcagtttcttayaaarctaaacatacaattaccatatgatccagcaatcayactcctaggtatttacccaagtgaattgaaaacwtatgtccacacaaaaacctgcacacgaatgtttatagcagctttattcataattgccaaaacttggaaacaaccaagatgtccttcaataggtgaatggataaacaaactgtggtacatccatacaatggaatattattcagcgataaaaaggaatgaactactgakacatgaaaagacatggatgaatctyaaatgcatattgctaagtgaaagaagccagtctgaaaaggctacatactgtacgattccatttatatgacattytggaaaaggcaaaactatagagacagaaaacagattagtggttkccagrggttgagagatgggaagtggggatgrytgcaaargtaaagcacargggattttttagggtgrtaaaactattctgtataaactattctgtatgatactatggtggtggatacacgacantatgcatttgtcaaaacccacagaacttgtcaaaacccacagaactttacagcataaagagtgaactttaatgtatgyaaattttaaaaaatcatttargagatcgggggatcycaggatggaatacagamtgtgacaaaagaatctaactgtattacaaatgtatgaaacaacctcactgaagggratgggggaaaaaggtgctgacctaagtaactttggaaatgagtggagtctgtaagactaaaggcaaaaggaactgcacataagcactgtactctagttrataaagttgtttyccayaggggtayaggttaacaattctgawacyactatatacgtatannaraattaaacaaataagtaaatgtatkgtagatgatgggagccaggtttctcactgtcggagtgaggagttacagataagcaaagggaggagrctagaatgaaccctgtggtattrgattagaattggaggtatcagtatgaactcatgrtttttaatatayryryryryryryrtttcctagttctgtccgctgagagggcctagaagcaacgacaccccagtagcaatgagcacacctagcacccagatcttggtttctaataccattctccaataaaaggaaccagggctccttggagaaatggctgattctaggactagggcaggaaatatacaagatgagcctggaacatcttgcartgccagaaaataaggaagtgctcaaaaacacaatgatrggggtatgtcaaagggacacagragccaactgaaagagctcccaatggccaaagctggaacaatttgagcaacaaaataaattatrgtagtattggattataacycaaagtataaaataaatatccatgagtccatactgatataaatgaatgattaaataaataaataaattgagaagataaataagtctctnntgcagaagaatttcaaataatttatgtagatarcctnccctcaaggaagtggagcgtaactccccactccttaagtgtgggatggatatagtgacttccttccagaaagcatagtataggacggaaaaaaaagtaaatttacwgtagagaaacctgacaaacactaccttagccaggtaatcaaagttagcatcaacaattgtaagtcatgttgatagyatatacccttgatatgatgtgataagaatggcacttcacctccgtggtcttcctcccaaaaacccataaccccagtctaatcatragaaaaatatcagacaaattccaactgagggacattctacaaaatacctgaccagtactcctcaaaactgtcaaggtcatcaaaaacaaggaaagtctgagaaactgtcacagccaagaggagcctaaggagacatgacaactaaatgtaatgtggtatcctggatgggatcctggaacagaaaaaggacattaggtaaaaactaaggaaatctgaataaagtatggactttagttaataataatgtatcaatattggtttattagttgtgacaaatgtaccatantaatgtaagatgttaayaataggggaaactggatgtggggtatatgggaactctctgtactatttttgcaactttcctgtaaatctaaaactatttcaaaataaaat

SEQ ID NO: 81 - DNA, 2724 bp, Homo sapiens
  repeat_region (1)..(2724): l1mc4
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cttgtatccagaatatataaagaactcttaaaactcaacaataaaaaaacaaacaacccaattaaaaaatgggcaaaagatctgaatagacatctcaccaaagaagatatacagatggcaaataagcacatgaaaagatgctcaacatcatatgtcattagggaaatgcaaattaaaacaacaatgagataccactacacacctattagaatggctaaaatcaaaaacactgacaacaccaaatgttggcgaggatgtggagcaacaggaactctcattcattgctggtgggaatgcaaaatggtacagccactttggaagacagtttggcagtttcttayaaarctaaacatacaattaccatatgatccagcaatcayactcctaggtatttacccaagtgaattgaaaacwtatgtccacacaaaaacctgcacacgaatgtttatagcagctttattcataattgccaaaacttggaaacaaccaagatgtccttcaataggtgaatggataaacaaactgtggtacatccatacaatggaatattattcagcgataaaaaggaatgaactactgakacatgaaaagacatggatgaatctyaaatgcatattgctaagtgaaagaagccagtctgaaaaggctacatactgtacgattccatttatatgacattytggaaaaggcaaaactatagagacagaaaacagattagtggttkccagrggttgagagatgggaagtggggatgrytgcaaargtaaagcacargggattttttagggtgrtaaaactattctgtataaactattctgtatgatactatggtggtggatacacgacantatgcatttgtcaaaacccacagaacttgtcaaaacccacagaactttacagcataaagagtgaactttaatgtatgyaaattttaaaaaatcatttargagatcgggggatcycaggatggaatacagamtgtgacaaaagaatctaactgtattacaaatgtatgaaacaacctcactgaagggratgggggaaaaaggtgctgacctaagtaactttggaaatgagtggagtctgtaagactaaaggcaaaaggaactgcacataagcactgtactctagttrataaagttgtttyccayaggggtayaggttaacaattctgaaactattttatatgtattgtaggattgagcaaataagtaaacgcattgaagataatgggagccaggtttctcactgtcggagaagggagttacaaatatggaatgggggaagrctagaatgaaccctgtggtattrgattagaattggaggtatcagtatgaactcatgrtttttaatatayryryryryryryrtttcctagttctgtccactgagagggcctagaagcaatgacaccccagtagcaatgagcacacctagcgcccagatcttggtttctaaataccattctccactaaaaggaaccagggctccttggagaaatggctgattctaggactagggcaggaaatgtacaagatgagcctggaacatcttgctrtgccagaaaataaggaagtgctcaaaaaatgatrggggtatgtcaaaaggacacagragccagcttgaaggggctcccactggccaaatctgggacaatttgagcatcaaaataaataacggtagtaatggattataactcattgaataaaataaatatccatgagttcatactaatataaataaatgaataaaagaaataaataaataagaragaaaggaaagytcttcttacagtagaatgccaactaayaaatgtagaaggaataaaataatagaaaaatcaccatttggcaaayaccacagtaataantgtttcaggcaagaaccatcgatagatgctaaaattagtgggcgaaartttgatgagaaacgggatatttgcatagtctcaaagtatctcyccacaagatatttattaattayaaagggaaaaatagtractttacagtagagaaacctggcagacaccaccttaaccaagtgatcaaagttancatcaccaataatgagacaaattgacatcatgcgcytcctgatgtgatgcgccgagaaggacacaacatcacttctgtgatattcytgccaaaaatgcataacctgaatctaatcatragaaaatatcagacaaacccaaattgagggacattctacaaaataactggcctgtactcttcaaaaatgtcaaggtcatgaaagacaaggaaagactgaggaactgttycagattgacggaagactagagacatgacaactaaatgcaacgcgtgatcctggattggatcctggatcgagaaacggtgggagtttktayctataaaggacattattgggacaattggcgaaatttgaataaggtctgtagattagataatagtattgtatcaatgttaatttcctgattttgataattgtactgtggttatgtaagagaatgtccttgtttttaggaaatacacactgaagtatttaggggtaaarggncatsatgtctgcaacttactctcaaatggttcagraaaaaaaatnnatatayataaryagagaatgataaagcaaatgcggcaaaatgttaacaattggtgaatctgggtgaagggtatacgggwgttctttgtactattcttgcaacttttctgtaagtttgaaattatttcaaaataaaaa

SEQ ID NO: 82 - DNA, 460 bp, Homo sapiens
  repeat_region (1)..(460): mer88
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cactgtattgtaaattttaaaaacttcmtattttcctgatgcctcaacatncccacaaacaggctgtgagcaccccgcccaggcgaccaggtgcaccagtgtaataaggctggtccctgctacaagttccccttcttgccttcccctgactgtgacccagtgacattcaaacgcaccagtgaaatccccttacgccttktgcttgtgtsctccaccctgacccccagkaaaggcacttgcccgnnngttctctctctccctgcctcntaccngcttggttgagcccgctccctgggcactcctcccatccggccccctgcatggcatggcntgcctccctctctaggacctgtgagtataataaannctttaanttacgtctctctgagtgcaatttctntggccgtgctggagtgatccttaaagaccccaccagaggnacttccccgtttacaacaca

SEQ ID NO: 83 - DNA, 559 bp, Homo sapiens
  repeat_region (1)..(559): mer89
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagagactgaatatacaaacggacaatggccagaccatatatgaaaatagaactctgacccacaacctctgcagcaacctgcccaggaaaccaatccccttatctacaattacaacaaasaaggcagcctgctgtaagtcagacttgcasaaagtcagattgctctctctagtaancagyccaggaagccaaacaacaacctctgcaacaattggcccmaaatggccaggacttgatcaataactgmcagcttccctaatttttgtccctgcttccaacttaggaccaaccagagaaagcyaaatatgcwccccwaaccaatcacataggatgccctgcttctagttagcccgcctmcagcttccccatgccaacaacctccaatcagggcatacctgaagtcttcccttttttccactataaagctttcccactcctctgcctgcctttgagtctctgccaaacgcaagtgatggtggctgactcccttgctatagcaagctctgaataaatagcctttgcttgttctcatttggktggtcttcatttatttccaca

SEQ ID NO: 84 - DNA, 510 bp, Homo sapiens
  repeat_region (1)..(510): mer9
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttgggaacaggcccccccaaatctggccataaactggccccaaaactggccataaacaaaatctctgcagcactgtgacatgttcatgatggccntaacgcccacgctggaaggttgtgggtttactggaatgaggacaaggaacacctggcccacccaggtcggaaaaccgcttaaaggcgttcttaaaccatgaacaatagcatgagcaatctgtgccttaagggcatgttcctgctgcagataactagccagacccaccccttcatttcggcccatcccttcttttcccataagggatacttttagttaatcgagtatctatagaaacaatgctaatgactggcttgctgttaataaatacatgggtaatctctgtttggggctctcagctctgaaggctgtgaggccctgatttcccactttacacctctatatttctgtgtgtgtgtctttaattcctctagtgccactgggttaggctgtccccagtcgagctggtctcgca

SEQ ID NO: 85 - DNA, 615 bp, Homo sapiens
  repeat_region (1)..(615): mer90
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagaaagagaaaagcagcccctgacatctgagagctggcctggtaccnwcagctaggccttggtgttgctgggagctggcctggcactcacagctaggccttggtgttctcctgttgaacataaacaatttcacagaatatcaacatcagacaaggccactctgtgaccatgatggatcgagacaaaaacaagaccactccgtaatcatgtctgaacacagacaaaaacatgaacattgtccaagccacaaaaatgaccaagcatccccctctcccggctaatatgagtgactgctgcttctttaccaattacagctttagcctcgctctagtcttccctccttctagataagatttattaagatacccaatcacagaattactcccgcttcctgacagcatccaatccagagcaaagcttcgcttccttaaaccctcccccaaatcacctaacacaagcccaaatcctataataagtcctttctaacatcctcttactgagacgccccgtggttccccatggtgtgcgttctccctcgctgcarcgagcaataaacccaacttgttcaaccacaggtgtgttcctggtggtctttggctggagggcactgaca

SEQ ID NO: 86 - DNA, 196 bp, Homo sapiens
  repeat_region (1)..(196): mer91a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagggctgccatgtacagttgtgcaggttgtgcactgcacaagggcgcctggccgagggagcgagtgggggctgaaatccagcccgtgctccgctcgccaagccgtgmgtcctggtgtggggctgcgtctacctagaggaaggggcgcctttttctaattcacacaaaggcgccgtatgggctagcnctggccctg

SEQ ID NO: 87 - DNA, 184 bp, Homo sapiens
  repeat_region (1)..(184): mer91b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagggctgccatgtacagttgtgcaggttgtgcactgcacaactctagggggcgccattcacatcatagacatcacagatttgtataatgacaattttccaacagatggcagtaaagtgtcttgaggaaggggcgcctttttctaattcacacaaaggcgccgtatgggctagcnctggccctg

SEQ ID NO: 88 - DNA, 140 bp, Homo sapiens
  repeat_region (1)..(140): mer91c
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagggctgccatgtacagttgtgcaggttgtgcactgcacaactctagggggcgccattcacatcatagatctatgatgtgaatggcgccccctagagttgtgcagtgcacaacctgcacaactgtacatggcagccctg

SEQ ID NO: 89 - DNA, 412 bp, Homo sapiens
  repeat_region (1)..(412): mer92a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaccaagtgttcacagttgttcgcttcttaccctctncttcgccttgacagaactttagtcaggcttctctccttcctacaggcccctgaactttgcttgcccctaagcctgagcaagcactmaaatgcagaacgtgccccccttakcagcttgtcctgagaatcggctgaccacagcgggacacatttcctgtcaaaccccaccnatcatgttgtntgctcgntccccctcgcttgcccactgtcycctttctactggttctgcttaycyctccctataaaagaaaagcctttttctgtttgattttgagacgcttgcaagttcctgaggtcggagcgttctccctattgcaatagtctttttgaataaagtctctccttatctaagtccggatttgtttttatttgaca

SEQ ID NO: 90 - DNA, 636 bp, Homo sapiens
  repeat_region (1)..(636): mer92b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgacaatgttgaactttacctgagccctgtgctcctggaaaacagtgawggttaagaaatccccccatccttttgtgttccgggaaacggcttactgcaaagaaccatccttccccatatgacttagataagactcatggatgncccccttgtttacctatgacaaggccagacacagaccctccaaattcccattctttgcctcataaatgattagctgaactgtttgtccccactgatcaatckggacaaaatacctgytaactcgactngaccaaactttagttaagcttctctccttcctccaggmccctgaactttggaccaccctcagcctgagccagcatcanaatgtagaacagcccctcctgagaataggctgrcctcaaggtaaracattctctgatctactctgatctcgccaccctttcatcccactcccccacacctggttctttctagccttgtttactcctccctataaaagaaaagccctttctgcctgaactttgagatgcttgcagatcttatggtcagagcgttctccctattgcaatagtccccytccccccmttgcaatagtccttttgaataaagtctctccttagctaagtccggatttgtttttatttgaca

SEQ ID NO: 91 - DNA, 554 bp, Homo sapiens
  repeat_region (1)..(554): mer92c
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgacaatgcwgaactttacctgagccctgtgctcccggaaaacagcgatggttaagaaatccccccatccttttgtgttccnagaaacggcttaccgcaaagaactacccttccctatatgacttaaataagactctctgncccttctttctcacgacttccataagatcannnatgattccttncctgnnaagaccaaacacagacctttccccttttgcctgaacccgctgacaaggccagacacggaccctccaacttcctattctttgtttcataaatgattagctgagattagaagngtctgtccccctgaaactagctagacacagagataaacatttcctgttcagctaaccgagacttcccctgattgcaaaacaaccccccctgtaaatctccccacntgaaacctatctaccccttcctataaaagtccaaggcaaaaccaccctgccgagacacttcatagtcttcggatcttggatgctctccctattgcaatagcctgaataaaatcatctccttamttgtctagtgcattttgtctttca

SEQ ID NO: 92 - DNA, 397 bp, Homo sapiens
  repeat_region (1)..(397): mer93
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttaaaataattaawtgggaggccattagactgaggtggctctagcgccctgggttcctacgtaagcaaaccgaaacctaactcagncgtttcttanaaataactatnaagaraaaatgaaacttaagctyagccaatcacaarcsgccaactaacctctgattacataaccagggacttcccacctggacagtccaaatraggngactgcncaactgtaaccaatcaaatactttatttgctctgcttcctcatncaccytataaaagcctttccttcaagcccctccggcggagccccaaaccacccgtggtctggggctgcccgattcatgaatcactgtttgctcaaataaactctttaaaattttaatgtgcctcagtttatcttttaaca

SEQ ID NO: 93 - DNA, 134 bp, Homo sapiens
  repeat_region (1)..(134): mer94
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tagggtgaccatataatttatcgtccaaaccgggacacttttgagagtgaaagggggcgctattaataattacgccaggacaacaggyataaaccaggactgtcccaggcaaaccgggacatatggtcacccta

SEQ ID NO: 94 - DNA, 431 bp, Homo sapiens
  repeat_region (1)..(431): mer95
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtttaagaaaataaaaatggaggccacagtttagatataccccaaggccaaccgcccatagccacgtaaccaaaatttaagtcatcctgatttccccaaaacgctagctctaatcataaacataacacaaaacgtaagctttacatccttgtcagcgtgattcagtgaaattaaaccaatcagctatagacaaatcagcttaaacagctctacttgccctaaaaagaatgttaatgtataacagccaatcacgaaaaaggtcaaaatacttcctcctttatgctttataaactgtgctatgactgccgtragnngagcttcttaccactttcrgyttgargtctcccggttcgcgarctgtwctttctctyattgtatgcacaataaactttaaaatttttcctaacttgatctgattttawttttgaca

SEQ ID NO: 95 - DNA, 175 bp, Homo sapiens
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagggccgggactagggtgaggcaagtgaggcgcctagggcgcaaaatttaaggaggcactcactctcagggtcgtgcaagtgcagggtcggcatttgcacgaccctgagagtgagtgcctccttaaattttgcgccctaggcgcctcacttgcctcaccctagtcctggccctg

SEQ ID NO: 96 - DNA, 434 bp, Homo sapiens
  repeat_region (1)..(434): mer96b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aggancagggtgagrcaagtgaggcactcgccttgggtacaaaatttaagggggtgccaaaaaactcagtaatcaagataaataatattttaatgcaatattttttttaaaatcaaaattaatgaaaaaatccatgacaaaatgtcaaaatkttaaataaagatatkatcagtatgactgatntttcattttgcctcaggctccagtatgagtngacactgcacagttrctgatcctgtatttaaaattttgatattttgttcatcatggatttttttgcattnattttgatttttnaaantattacattaaatactatgtanctwtwtwatryattcagatattatttatcttgattnctgartgttttggtacctycttaaattttgcgccygaggnragtgcctcnctcgcctcaccctagttctggntct

SEQ ID NO: 97 - DNA, 1106 bp, Homo sapiens
  repeat_region (1)..(1106): mer97
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggcagtcctcgctttgcacggttccgatatgcatgaatttcagttaccacggtttagttaaataacaccagtcccccaacaacacggttcaaatttcagttaccacggtatattaactgtgagtaattgcataaagtacaaacttcgctgctagctcttcagtccacaaatcactacataaataacagatgcgcatcatgatcagtgaccaatcacatcacttctttcaaagtctgtcggtgattggtcactgtgcatctgttattcagttcatgcacagacagcaaagcgtgtagttgtgttgcctccttgtctcccagtgataaacccacgtgacattttacaaaaatggataatcgaaagagggaattggccaacaaagatgaaagtgcagcaaagaaacgaaaagtgataatgctggaagtgaaattcgaatcaaacgtaaatggagttatagaagaaatagctgaccgtgggaatgttgacactgccgccatttgagagactctagatatgcagccagaggaacttagtgaaggcgaacttatcgacataaatgaggaaagtggttgtgacgaaaaggatgaagatgtcccagaggaagtgacgccagcaaaaaacttcacattaaaggaactcttggagatatttcacgacattgaaagcgcaaaggataaaatgttggaagctgatccaaacttagaaaggagtatgacaatttgccaaggcatagaaaagatgcttactccgtatcgtaagttatataaagaagaagaaggcaagcactgttcaaactactcttgataagttttttttggtttgttttgataagtttttttacaaagaaataaaacactttaattctcaatgtttctaatgttttaaattatagtgtactaaataaatattagttttattatttttttcattccctatacatttataaccgacggtaagagagtttttaatgtttttgacaaaaatttttaaaggtcacggaacaattataattttcccattgattattaagatcgctttgcatggtttcagcttgcatggtcatttttacggtcccgtactaccgtgcaaagcgaggactgcctg

SEQ ID NO: 98 - DNA, 787 bp, Homo sapiens
  repeat_region (1)..(787): mer99
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aartcagaattcctgnaarttctyagraattytccaartcataagttattcttaaamtaytwcygtctcaaaacaaaacaaaaaaattgtaacatycttcmnacnnyttaytcattatyatrgayatctaaaaatytgtttrnttaawaacraatattnagcttagtaggatttacaaaraaytayagyytataataaatattcaaacactgaaaaacashancaaanattattgggtagtattcaaataacattcagatctcctaacaaagttasgrgacaacactacacagagtcanatgtcnaaactgccaatttaaggacttattttgcttccaaaacyyattatttcttggaataccactcataggatttgtataaagtatacnatrcatataaacntattaatatttattttatttgcaagaatgattcaccattagcagyakacarggccatgaacacatasttanaatggcaacagctacaagcaaggctgactgattaattraatngtgccacttctctcttacgtgytcctgtcctggtttctrgaaataccraccttaaccttcaactccatgtgcymanrtttyctgctcytgctttcaacttgntgtcactggattccttcaaatcagtaatgtctctatgttgattgttaagttttaatttttcagagaataanattttttcttattttcccratttttyaactgatttttcttgggattcagragaaaaatttcttaagaaatgccaggaaggaattcccacttggaaacac

SEQ ID NO: 99 - DNA, 262 bp, Homo sapiens
  repeat_region (1)..(262): mir
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
acagyayagcatagtggttaagagcacggrctctggagccagactgcctgggttcgaatcccggctctgccacttactagctgtgtgaccttgggcaagttacttaacctctctgtgcctcagtttcctcatctgtaaaatggggataataatagtacctacctcatagggttgttgtgaggattaaatgagttaatayatgtaaagcgcttagaacagtgcctggcacatagtaagcgctcaataaatgttrgytattatt

SEQ ID NO: 100 - DNA, 374 bp, Homo sapiens
  repeat_region (1)..(374): mlt1a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgctatggactgaatgtttgtgtccccccaaaattcatatgttgaagccctaatccccaatgtgatggtattaggaggtggggcctttgggaggtgattaggattagatgaggtcatgagggcggggccctcataatgggattagtgcccttataaaagagaccycagagagctcccttgccccttccgccatgtgaggacacagtgagaaggcgccgtctacgaaccagggaatgagccctcaccagaaactgaatctgccggcgccttgatcttggacttcccagcctccagaactgtgagaaataaatttctgttgtttaagctacccagtctatggtattttgttatagcagcccgaacagactaagaca

SEQ ID NO: 101 - DNA, 390 bp, Homo sapiens
  repeat_region (1)..(390): mlt1b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttatgggctgaattgtgtccccccaaaattcatatgttgaagtcctaacccccagtacctcagaatgtgactgtatttggagatagggtctttaaagaggtaattaagttaaaatgaggtcattagggtgggccctaatccaatatgactggtgtccttataagaagaggaaattwggacacagacacgcacagaggraagrccatgtgargacacagggagaaggcggccatctrcaagccaaggagagaggcctcagaagaaaccaaccctgccgrcaccttgatctcggacttcyagcctccagaactgtgagaaaataaatttctgttgtttaagccacccagtctgtggtactttgttacggcagccctagsaaactaataca

SEQ ID NO: 102 - DNA, 466 bp, Homo sapiens
  repeat_region (1)..(466): mlt1c
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttatgggttgaattgtgtccccccaaaattgatatgttgaagtcctaacccctagtacctcagaatgtgaccttatttggaaatagggtcwttgcagatgtaattagttaagatgaggtcatactggagtagggtgggccctaaatccaatatgactggtgtccttataaraagaggaaatttggacacagacacgcacacggggagaaggccatgtgaagacggaggcagagattggagtgatgcakctacaagccaaggaacgccaargrytgccagcaaaccaccagaagctaggaagaggcaaggaacagattctccctcacagccytcagaggarrccagccctgccgacaccttsatctcggacttctggcctccagaactgtgagagaatamatttctgttgtttaagccacscagtttgtggtactttgttacggcagcccyaggaaactaataca

SEQ ID NO: 103 - DNA, 506 bp, Homo sapiens
  repeat_region (1)..(505): mlt1d
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggtaggcwgaataatggctccccaaagatgtccacgtcctaatccccagaacctgtgaatatgttaccttacatggcaaaagggactttgcagatgtgattaagttaaggatcttgagatggggagattatcctggattatccgggtgggcccaatgtaatcacaagggtccttawaagagggaggcagagggtcagagtcagaagaaggagatgtgacgatggaagcagrragnngaaaactcaacgttgctggctttgaagatggaggaaggggccatgagccaaggaatgcgggcagcctctagaagctggaaaaggcaaggaaacggattctcccctagagcctccagaargaacgcggccctgccgacaccttgattttagcccagtgagacycattttggacttctgacctccagaactgtaagataataaatttgtgttgttttaagccactaagtttgtggtaatttgttacagcagcmayaggaaactaataca

SEQ ID NO: 104 - DNA, 568 bp, Homo sapiens
  repeat_region (1)..(568): mlt1e
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggtaggcagaattctaaratgmtcccaatgatcctcgcctcctggcgtaatctccttgagtgtgagtaggacctgtgacttgcttctagccaacggaatatggcaaaggtgatgaratrtcacgtgattacgcgtacgtgattatgtaasattcagtctttgmcgtcattcttgccgagagactctcctsctggtyttgaagaagtaagctgccacgtcatgagnnnncnnannagarygccgcaaggcaagggnntctagagctgagagtcgcccttactgatgggcagcaagaagcaagccacctcagtcctacagccgcaaagaactgaattctgccaacaacctagtgagcttggaagcagatcctgcccagtcgagcctccagatgagancgcagccctggctgacgccttgactgcagccttgntagaccttgagcagaggacccagctaagccgtgcccagactcctgacccacagaaactgtgagataataaatgtgtgttgttttaagccgctaagtttgtggtaatttgttacgcagcaatagaaaactaacaca

SEQ ID NO: 105 - DNA, 641 bp, Homo sapiens
  repeat_region (1)..(641): mlt1e1
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tggtaggcagaattctaagatggcccccaagattcycaccccctggtatcatatrccctgtataatcccctccncttgagtgtgggcaggatctgtgaatacgatgggatatcactcctgtgattaggttacattatatggcaaaggtgaagggattttgcagatgtaattaaggttcctaatcagttgactttgagttaatcaaaagggagattatcctgggtgggcctgacctaatcaggtgagccctttaaargaggytctagaagtcagacatggaagaagtcagagagattcaaagcagcagagatgctctcctgctggccttgaagaagcaagctgccatgttttgtggagagggccatatgncagggantggngagcagcctctaggagcngaagtcctcagtcctacaaccacaaggaaatgaattctgccaacaaccngartgagcttggaagaggatcytgagcctccagatgagaaygcagccccagctaacaccttgatttcagccttgtgagaccctgagcagaggacccagctaagctgtncccagattcctgacccatagaaactgtgagataataaatttgtgttgttttaagctgctaagtttgtggtaatttgttatgcagca

SEQ ID NO: 106 - DNA, 593 bp, Homo sapiens
  repeat_region (1)..(593): mlt1e2
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgccctaatcctggaacctatgaatacgttacatnacatagcaaaagggattttgcagatgtaattaaggttactaaccttaaaatagggagattancctggattatctgggtgggcctaatctaatcacatgagcccttaaaagcagagagttttctccggctgatagcaggaaatgtaaagcagaagaggaagtcagagagatttgaagcatgagaagrattcgatgtaccattgctggctttgaagatggagggggccacgatgcaagaaatggaagaggcctctaggagctgagagtggctcccagctgacagccagcaaggaaatggggacctcagtcctacaaccacaaggaactgaattctgccaacaacctgaatgagcttggaagtggattcttccccagagcctccagataagagcccagcctagctgacacctttgatttcagccttgtgagaccttaagcagagaacccagttaagcctacctggacttctgacctacagaactgtgagataataaatgggtgttgttttaagctgctaaatttgtggtaatttgttacacagcaatagaaaactaataca

SEQ ID NO: 107 - DNA, 541 bp, Homo sapiens
  repeat_region (1)..(541): mlt1f
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggtagccagcctccaagatggcccccaatgatccctgctcctggtattcacayccttgtatggtcycytcctacattgaryyagggctrgtctgtgtgaccaatagaatagggcagaagtgatggcgtgtsacttccaagaytargtcayaaawaacactgtggyttctgcyttgntctcttcgggctactcactctgggggaagccagctgccatgctatgaagacactcaagcagcctatggagaagtccacgtggsaaggaactgaggtctcctgccaacagccagcttcgacytgccagccatgtgagtgagccatcttggaagcggatcctccagccccagtyaagccttcagatgactgcagccccggctgacatcttgactgcaacctcatgagagaccctgagccagaactacccagctaagctgctcctarattcctgacccacagaaactgtgagataataaatgtttrttgttttaagccactaagttttggggtaatttgttacgcagcaatagataactaataca

SEQ ID NO: 108 - DNA, 561 bp, Homo sapiens
  repeat_region (1)..(561): mlt1f1
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtccacaaattctttgatactcctcttaagaggtggagtctaattcccctccccttgaatntgggctggacttagtgacttgcttctaaccaatagaatatggcagaagtgatggtatgtgacttctaaggctaggtcataaaaggcattgywgtagcttcctncttgctctctctctctctctctcttggatcactcactctgggggaagccagctgccatgtcatgaggacactcaagcagccctgtggagaggcccatgtggcaaggaactgaggcctcctgccaacagccagcaaggaactgaggcctcctgccaacagccatgtgagtgagccatcttggaagcagatcctccagccccagtcaagccttcagatgactgcagccccagctaacatcttgactgcaacctcatgagagaccctgagccagaaccacccagctaagctgctcctaaattcctgacccacagaaactgtgagagataataaatgtttgttgttttaagccactaagttttggggtaatttgttatgcagcaatagataactaataca

SEQ ID NO: 109 - DNA, 512 bp, Homo sapiens
  repeat_region (1)..(512): mlt1g
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggcggattttaaaaatggccacaaattctttgacactcttcccatcgaggagtggggtccgtntcctctccccttgaatctgggtgggctctgtgactgcttcgaccaatagaatrcggtggaagtgatgctrtgtgacttctgagsccaggtyataaaarrcattgcagcttcctgcttgctggaackctcacacttggagtcctgagccaccacgtaagaagttcarctrccccgaggccaccatgctgtgaggaagcccaagctastccacanagagaaaccgagccatcttgraagcggatcctccagccccagtyaagycttcagatgactgcagcyccggctggcgtcttgactgcgccgataccacgtgggacagagawgaactrcccagctaagcccagcccaaattgctgacctatagtattgrgaacgaataaatgrttattgttttaagccactaagttttggggtggtttgttacgcagcartagataactgaaaca

SEQ ID NO: 110 - DNA, 379 bp, Homo sapiens
  repeat_region (1)..(379): mlt1g1
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggcagattgtattttccaaagatggccacaacaatatctcccatcccacatgctcttctttcaatgtgacctttgccacttcttccatcaagaggtggggtctatgtcccctccccttgaatctgggcagacctttgtgactgccttgaccaatagaatatggtagaagtgatgctgtgtgacttctgaggctaggtcataaaagtgccatgcacttctgccttgctcacttgggacactcactcttggaacccagccaccatgctgtgaggaagcccaagcagcccatggagagacccgtggagaggatctgaggttcctggtcnacagccccagctgagctcccagccaacagccagcatcaacttgccagcca

SEQ ID NO: 111 - DNA, 622 bp, Homo sapiens
  repeat_region (1)..(622): mlt1g2
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggcagattgtattttccaaagatggccacaacaatatgtcccttccacatgctttcttcaatgtgactttgacactcttcccatcaagaggtaggggtctatgtcccctccccttgaatctgggtaggcttgtgactgcttctgaccaatagagtatggtagaagtgacactgtgtgacttctgaggctaggtcataaaaggcaatgcagcttctgcctgccttgttcgctggaacactcactcttggagccctgagccaccatgtaagaagtctgactaccctgaggctaccatgctgtgaggaagccaagccacatggagaggccatgtgtaggcattctgatcaacagccctagtgtttgagtcatcccagcccaggtgccagacatgtgagtgaagaagccttcagatgattccagcccccagccattgagtcacccccagccttcgaatcttcccagctgaggccccagacatcatggagcagagacaagccatccctactgtgccctgtctgaattcctgacccacagaatctgtgagaangcataataaaatggttgttttaagccactaagttttggggtgrtttgttacacagcaatagtaactggaaca

SEQ ID NO: 112 - DNA, 547 bp, Homo sapiens
  repeat_region (1)..(547): mlt1h
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggtagntgattgcaaaaatgacmccattctccacccctccctgtatccatgccctttgcaatgtgactttgcagctcctcccatcaagaggcggagtctgtttccccaccccttgaatctgggctggccwtgtgacttgctttggccaatrgaatgckgcagaagtgacggtgtgccagttccgagcctaggcctcaagaggccttgcgtgcttccgctcnctctcttggaaccctgccaccgccatgwgaacaagcccgggctagcctgctggaggatgagagaccacgtggaggagagccgagscgccccagctgaggccatcctggacmggccagcccccagccaagatcagcagagccaccaantcaaccagcagctgaccacagatgcatgagggagcccagctgagaccagaagaaccgcccagctgagcccagcccaaattgccgacccgcagaatcgtgagctaaaataaatggttgttgttttaagccactaagttttggggtggtttgttatgcagcaatagctaactgataca

SEQ ID NO: 113 - DNA, 313 bp, Homo sapiens
  repeat_region (1)..(313): mlt1h1
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagancaccatgcttgagaggccacgtgtaggagctcnagtnranagtcctagctgagcccagccttccagccatccctaccaaggtaccagacatgtgantaaagccatcttggattgtctaggccagcccakctgccagmtgaataccactgagtgaccccagtcaatnctayatggancagaagaatcaccnagctaagccctgcccaaattcctgacccacaaaatcatgaratataataaaatggttgttgttttaagcyactaagttttgggatacttttctacacatcaatagataactggaaca

SEQ ID NO: 114 - DNA, 314 bp, Homo sapiens
  repeat_region (1)..(314): mlt1i
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tggccatgtgacttgctttggccaatgaaatgtgagcagaagtgacatgtgtcacttctaggtagaagcatttaagagccagtgcgtagattcgccatrattctctttccctctgccatgagaccacaatgttccagatggaggctgctccatcagcctgggtccctgagtgaggaatgacatggagcagagccccagctgacctacaatagacatgtaacatgagtaagaaataaacctttgttgttttaagccactgagatttgggggttatttgttactgcagcataacctagcctatcctgactgataca

SEQ ID NO: 115 - DNA, 516 bp, Homo sapiens
  repeat_region (1)..(516): mlt1j
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggcagagactgctagttgtcccccaatatccattctccccttcttccttagtaatagaamccccaatttttagctgggcacatggccacccagaaataaagactacatttcccagcctcccttgcagctaggtgtggccatgtgactttctaagttctggccaatgagatggtaagcagaagtgatgtgtgcaacttctaggaaatgtccttaaagagaggggcaygcccttcttttccccttcctccttcctgctgcctggaatgtagatgtgatggctggagctctagcagccatcttggaccatgaggtgaaagccacatgctaaggatggcagagcagcaagatagaaggagcctgggtccctgagactatggagcagagctgccataccagccctggactgcctacctctagacttctatatgagagagaaataaattctatcttgtttaagccactgttattttgggttttctgttacttgcagctaaacctaatcctaacayacca

SEQ ID NO: 116 - DNA, 435 bp, Homo sapiens
  repeat_region (1)..(435): mlt1j1
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tggctagctgttcaccaaatctgtttccttttcttcctgggcacacagctagactacatttcccagcctcccttgcagcttaggtgtggccatgtgactgagttctagccaatggaatgtaagcagaagtgatgtgtgtcacttccaggcctggcccataaaacctcccatgccatcttcctctctattctctcttctsctgcatctgctggctggatgttaacacccagggtgaccttggaagccatatgttgaagatggcagagcctccatcagcctgggtccctgaatgactgtgtggagcagagcaccactcccacccccccatcatcaattggactttacatgagcaagaaataaacttctattgtgttaagccactgagattttgagggtttatttgttacagcagctagtgttaccttaactaataca

SEQ ID NO: 117 - DNA, 417 bp, Homo sapiens
  repeat_region (1)..(417): mlt1j2
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggcagagactggctaggtgttcaccaaacccatttccttttcctcctgggcacacagctagactacatttcccagcctcccttgcagttaggtgtggccatgtgacntgagttctggccaatggaatgtgggcagaagtgatgtatrccacttccaggcctggcccataaaaccctccaatayataatcctctctctctctttcttcmtcbrctggctggatgcagagaatccaaaggactccaaggatggtagagccacaagatggaaggagcctgggtccctgagtcactacttggaggagagccactcagcagaaacacccnaccagaaacccacactgaattgtaacatgagtgagaaataaacttttattgtgttaagccactgagatttgggggtttttgttacagca

SEQ ID NO: 118 - DNA, 476 bp, Homo sapiens
  repeat_region (1)..(476)
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggttctrgtggggctgactccaacccctagctccaggggtgggcacatgacccaggcctggccaatcagagcattccatcccyctggccacagtgattggttcagggatgggcatgtgacccaagctgggccaatgagagttctcaagccctgggacttttgctggaactattgggaaagagrtgttctttttctcctggggttgctaagctggtaggatgtaagcctggagctgctggtggtcatcttgccaccacrtggagagagcctgcctgagaatgaagccaacacagaggaaagcagagccaagagatggagagagacagattcctgatgacatcatttgagcacctggatccagccatgcctgaagccagatctatgctacccctggacttttcagttacatgagccaataaattctcttttttgcttaagcyagtttgagttgggtttcttgtcacttgyaacca

SEQ ID NO: 119 - DNA, 356 bp, Homo sapiens
  repeat_region (1)..(356): mlt1l
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaatcttgattggtctaagccaatcatggtaaatcctattccccttgccagtgattggtttaggaatgggcatgtgacacaattctggccaatgagacatgaggggaagtctgctgggngggcttctggaaaagnttttcttttttaattaaaaaatntaaagagaaaacatgtcctcttttcttgctcttgntttggatgttgttttgtgaggatgtgatgcttggagctgtggcagccatcttgcaaccatgaggcgacaagcctgagangraaagccaacacactgaggatggcagagcagaaagataaaaagaacctgggtccttgatgatatygttgagctgctgaatca

SEQ ID NO: 120 - DNA, 1338 bp, Homo sapiens
  repeat_region (1)..(1338): mlt1r
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gattttggcactaggaagtggggtgcttacgtaacaaatacctaaaaatgtggaagcgactttggaactgggtaataagtagaggctggaagagttttgaggtacatgytagaaaaagcctagatttccttgaagagactgttggtagaaatatggatattaaaggyaattctggtggggggctcagaaaggaagwggagagctatagagaaagctcccgtcgtcttagagaatacaaaaatcgtcatgaacagaatgttgctagaaatatgaatgttaaaggtgcttctggtgaggtctcagacggaaatgagggagatgttattgaaaattggaggaaaggtgatccttgttataaagtagcaaagaacttggctgaattgtgttcatgtcctagggctttatggaaagtagaacttgyaagtgatgaactkggatattcagctgaggaaatttctaagcaaagtgttgagggcgcaacctgacttctcctaactgcttatagtaaaatgtgagagacataaagatggaantgttgagtaaaaaggaaccagaacgtaaagatttggaaaattctcagcctgatcatgtaacagaaannncaatagcgttctctggaaagaanaccaaggatgtnnccgngcaaccgtttgctaaagagattagratcgtgactcgtgggtccaatcaaccatctcagcaraarccargaatagagatgrggttatttaggaaatatctgtggaggactctcttatctgatggctcgaacccctatgacttncataggagaccgacaaggnttttgagaatnttacaccagcagaaacactgccaacttggactraagggracagagacgagaaaaaatgaaggaagrgtggcagaccgaaggtggggctgtctcgtttcagagcatggkgtcaccccagcgggcccggaagatgaatctcaggactcagaggcattagcctccagccttaagatctaatgaagtttgccctgctgggttttggacttgcttgggaccngtgactcctttcttyyyttcyatttctcccttttggaatgggaatatctatcctatgcctgycccaccgttgtattttggaagcagataacttgtttnattrcacaggtccacagatggagaggaattttgccyctgaatgaatctyaccctgagtytctnccayacytgatgyrgrtgatatttcgctgagattgtggactaagagttggtgctggaaggggttagacattggggagatgttgctatgggatgcagggattttgcatgtgagaaggacatgattatggggggagcggagggcaaac

SEQ ID NO: 121 - DNA, 444 bp, Homo sapiens
  repeat_region (1)..(444): mlt2a1
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgatggttaatactgagtgtcaacttgattggattgaaggatacaaagtattgatcctgggtgtgtctgtgagggtgttgccaaaggaggttaacattggactcagtgggctggggagaggcagacccacccttaatctgrgtgggcgcmatcyaatcagctgccagcgtggctagaatataaagcaggcagaaaaatgtgaaaagagagactggcctagcctcccagcctacatctttctcccgtgctggatgcttcctgcccttgaacatcagactccaagttcttcagttttgggactcggactggctctccttgctcctcagcttgcagacggcctattgtgggaccttgtgatcgtgtgagttaatacttaataaactcccctttatatatatctattcyattagttctgtccctctagagaaccctgactaataca

SEQ ID NO: 122 - DNA, 549 bp, Homo sapiens
  repeat_region (1)..(549): mlt2a2
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgatggttaatattgagtgtcaacttgattggattgaaggatgcaaagtattgttcctgggtgtgtctgtgagggtgttgccaaaggagattaacatttgagtcagtggactgggagaggcagacccaccctcaatctgggtgggcaccatctaatcagctgccagcacggctagaataaagcaggcagaagaatgtggaaggagcagactkgctgagtcttctggccttcatctttctcccgtgctggatgcttcctgccctcgaacatcagactccaagttcttcagcttttggactcttggacttacaccagtggtttgccaggggctctcaggcctttggccacagactgaaggctgcactgtyggcttccctacttttgaggttttgggactcagactggcttccttgctcctcagcttgcagacggcctattgtgggacttcaccttgtgatcgtgtgagtcaatactccttaataaactcccyttcatatatacatctatcctattagttctgtccctctagagaaccctgactaataca

SEQ ID NO: 123 - DNA, 503 bp, Homo sapiens
  repeat_region (1)..(503): mlt2b2
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgatggttaattttatgtgtcaacttgactgggctaargggtgcccagatagctggttaaacattatttctgggtgtgtctgtgagggtgtttccagatgagattagcatttgaatcagcggactgagtaaagaagattgccctcaccaatgtgggcgggcatcatccaatccgttgagggcctgratagaacaaaaaggcagaggaagggtgaatttgctctctctccttgagctgggacatccatcttctcctgcccttggacattagaactccaggttctcgggccttcggactycgggacttgcaccagcagccccccagattctcaggccttcggactcggactgaryyacgccaccggcttccctggttctccagcttgcagacggcatatcgtgggacttctcagcctccataatcacgtgagccaattcccctaataaatcycytctatccatcctattggttctgtctctctggagaaccctgactaataca

SEQ ID NO: 124 - DNA, 450 bp, Homo sapiens
  repeat_region (1)..(450): mlt2c2
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgatagttaattttatgtgtcaacttggctaggctatggtgtccagacgtttggtcaaacaycagtctagatgttgctgtgaaggtattttrtagatgtgattaacatttayagtcagttgactttaagtaaaggagattaccctccataatgtgggtgggcctcatccaatcagttgaaggccttaagagcaaagactgaggtttcccgaggaagaagaaattctgcctcaagactgcaacgtggaaatcctgctgntttwccagcctccaagccttcggactcgaactgcaacatcarctcttscctgggtctccagcctgccggcctaccctgcagatttcggacttgccagcctccacaatcgcgtgagccaattccttaaaataaatctctctctacacacaccctattggttctgtttctctggagaaccctgactaataca

SEQ ID NO: 125 - DNA, 388 bp, Homo sapiens
  repeat_region (1)..(388): mlt2d
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgatagttaattttatgtgtcaacttggctaggctatggtgtccagacgtttggtcaaacattagtctgggtgtttctgtgaaggttattttttggatgagattaacatttaaatcggtagactgagtaaagcagattaccctccctaatgtgggtggacctcatctaatcagttgaaggcctgaatggaaaaaaagggctgaccctcccccaagtaagaggaaattctgcctgcctgatngtcttcgaactggaatatcagctctgcggattttggacttgccagcctccataattgcatgagccaattccttataataaatctatctactctctctacacacaccctattggttctgtttctctggagaaccctgactaataca

SEQ ID NO: 126 - DNA, 622 bp, Homo sapiens
  repeat_region (1)..(622): mlt2e
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgctggattgttctgttgtcaacttngttaagctnggaactatgtttcccagaatccccttccctgtatggttctgggttagagttggccaaagatgaaattgtggaagatttggaaggcagaagtgaagcagcagccattacactctgaaggtcatcattggttasaggcagtgagagatggccagatgcagaggtgcccaggaggttccagcttgtcctcactctcccctgctcyatatccagctcttcttcctgaccactggccctgctgaccaacagcarccccaggcccaccaccagatgcttggctgcaaactcacagaggtagtngccacacagagncaacaactttccatagagttctccaccagctccccttcatggtcncacttyagcggctggatatgcttagcttcaaatttccccacaagctccagnctcattcaactncgccagagctggttagtgaccctttttctgatccttcaactcccccctccagaccttcacttccccagctcctcccacaattgtataaggtctaattcctataataaatcccttattccatanatactacatagtggctctgcttccctgactganacctgactaataca

SEQ ID NO: 127 - DNA, 661 bp, Homo sapiens
  repeat_region (1)..(661): mlt2f
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggtggctttgtaatgtgtcaacttggctaggctggaactacatttcccagaattcccttccctgtatrkttccaggttagggtgggccacaagagacattctgtgtgagatttggaaggcggaagtgaagcagcagccattttgttttctgtgctcggagaggtcagagtcagcaggcgctgttgcagctcacacacgttgtcgctkatctgctggctcacctcgttggcgtggggcagcagccgggcccgcagctgctccascttcccctggatcctccttcagcttctccgactcctgggccaggtgtgtgtktagctccgtgacgaagggcgccagcttctcctgcaggacacccacatcatcgaggtcggaggcagtgagagactgacatgggttccagtttgtcctcgtgggttccagctcatgcttgtgggttccagcttgtccttgctctcccccactttatatccatcttcccttcctgactgcctgccctgtggacttcaagctccagcatcagacgcaragacaacagccttacagagactgcttaaccagctcccacaattgcgtaaggtcaaatccctataataaatctcttattatatatatctcctagtggttctgcttctctgattgaaccctgactgataca

SEQ ID NO: 128 - DNA, 281 bp, Homo sapiens
  repeat_region (1)..(281): msr1
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
agtcaagacccccagcccctcctccctcagacccaggagtcaagaacccccagcccctcctccctcagacccaggagtcaagaacccccagcccctcctccctcagacccaggagtcaagaccccccagcccctcctccctcagactcatgagtccagacccccagcccctcctccctcagacccaggagtccagacccccagcccctcctccctcagacccaggagtccagacccccagcccctcctccctcagacccaggagtccaggccccacccctc

SEQ ID NO: 129 - DNA, 426 bp, Homo sapiens
  repeat_region (1)..(426): msta
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgatatggtttggatctgtgtccccacccaaatctcatgttgaattgtaatccccaatgttggaggtggggcctggtgggaggtgattggatcatgggggcggattyctcatgaatggtttagcaccatccccttggtgctgtyctcgtgatagtgagtgagttctcatgagatctggtcgtttaaaagtgtgtggcacctcccycctctctctcttgctcctgctctcgccatgtgacgtgcctgctcccccttcgccttccgccatgattgnaagcttcctgaggcytccccagaagccgagcagatgccagcgccatgcttcctgtacagcctgcagaaccgtgagccaattaaacctcttttctttataaattacccagtctcaggtatttctttatagcaatgtgagaacagactaataca

SEQ ID NO: 130 - DNA, 465 bp, Homo sapiens
  repeat_region (1)..(465): msta1
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgctatagtttggatatttgtcccctccaaatctcatgttgaaatttgatccccaatttggcartgttggaggtggggcctagtgggaggtgtttgggtcatgggggcagatccctcatgaatagattaatgccctcctttgnggtgggaatgagtgagttctcactctattgtgggaatctattagttcccataagagctggttgttaaaaagagcctggcacctncctcctctctctctcttgcttgcttcctctctcaccatgtgatctctgcacacgctggctccccttccccttcaccttcygccatgagtggaagcagcctgaggccctcaccagatgcagatgctcgcaccatgctttttgtccagccagcagaaytatgagccaaataaacctcttttctttataaattacccagcctcaggtattcctttatagcaacacaaaatggactaagaca

SEQ ID NO: 131 - DNA, 1651 bp, Homo sapiens
  repeat_region (1)..(1651): mstar
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gaawattggtactgaggagtggagcattgctataaagatacctgaaaatgtggaagcgactttggaactgggtaacaggcagaggttggaagagtttggagggctcagaagaagacaggaagatgagggaaagtttggaacttcttagagacttgttaaatggttgtgaccaaaatgctgatagtgatatggacagtaagggccaggctgacgaggtctcagatggaaatgaggaacttattgggaactggagcaaaggtcactcttgttatacattagcaaagagcttggctgcattttgcccctgccctagagatttgtggaagtttgaacttgagagtgatgatctagggtatctggcggaagaaatttctaagcagcaaagcgttcaagatgtgacctggctgcttttaacagcttacagtcatatgcgagagcaaagaaatcacttaaagttggaatttatatttaaaagggaagcagagcgtaaaagtttggaaaatttgcagcctggccatgtgatagaaaagaaaaacccgttttctggagagaaattcaagcaggctgcggagcgaccgtttgctaaagagattagcataactaaaaggaagccaagtgctgatagccaagacaatgggaaaaaggcctcgaaggcatttcagaaatcttcgaggtggtccttcccatcacaggcccagaggcctaggaggactgaatggtttcgtgggccaggcccagggccccgctgccctgtgcagcctcgggacactgctccctgcatcccggctgctycggctccagccgtggctcaaagggccccaggtacagctcgagctgccgcttcggagagtgcaagctataagccttggtggcttccacatggtgttaagcctgcaggtgcacagaatgcaagagtgaaggaggcttggcagcctccacctagatttcagaggatgtatgggaaatcctgggtgcccaggcagaagcctgctgcagggacggagccctcacagagaacctctactagagcagtgccaaagggaaatgtggggttggagcccccacacagagtccccaccggggcactgcctagtggagctgtgggaagggggccactgtcctccagaccccagaatggtagagccactggcagcgtgcaccgccagcctggaaaagccgcaggcatcagactccaacccgtgagagcagccacgtgggctgtgcccagcaaagccacaggggcggagctgcccaaggccttgggagcccacccctcgcaccagcgtgccctggatgcgagacacggagtcaaaggagattattttggagctttaagatttaatgactgccctgctgggtttcggacttgcgtggggcctgtagcccctttcttttggcccatttctcccttttggaatggaaatatttacccaatgcctgtaccaccattgtatcttggaagtaaataacttctttttgattttacaggctcataggtggaaggaacttgccttgtctcagatgagactttggactttggacttttgagttaatgctggaatgagttaagactttgggggactgttgggaaggcatgattgtattttgcaatgtgagaaggacgtgagatttgggggaaccaggggcagaa

SEQ ID NO: 132 - DNA, 405 bp, Homo sapiens
  repeat_region (1)..(405): mstc
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgctacggtttgaatgtttgtcccctccaaaactcatgttgaaacttaatccccaatgtggcagtattgagagrtggggcctttragaggtgattgggtcatgagggctctgccctcatgaatggattaatggattaacgtattaatggattaattggttatcacgggagtgggatcggtggctctatcataaaarycattttgnctctcgnrtgngccccttcttgccctttcacgccttccgccatgttatgacagagcacaaggccctcaccagaaaccagatgcagccgccatgatcttggacttcccagcctscagaaccgtgagcaaaataaacctcttttctttataaattacccagtctatggtattccgttaaagcagcacgaacggactaagaca

SEQ ID NO: 133 - DNA, 630 bp, Homo sapiens
  repeat_region (1)..(630): ors1
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ycccatacygtttccrtcactrgtytgwgcaccctctgcarggmagacagcatgayttttyatctttgaatycyyaaaasttagctcactgtgtgctcaaacgtgtattgaatgacagttgctatatttgaggacbacatagattttggggaagacggacaggcacactagcagaaccatacgaaggccaggatcagtcatgaccagggctgcattatgacttgtgggccctgagcacttttgcttttatgggccccttcctccataaaaatattaaaaattatattttatgactgcattggtataaagatgagaatataatccaggctgaattaaaacattttcttagactctaaaatttcatttttttctgattttaaaagaaattaaaacattttyatggggccctaaagtattgtgggccctaggcactgtgcctactgtgcctaatggataagtcnagcctgaccagggcactctggtgtgaggttgaagaaaggaaatttggaacaaagaagccaagtgctctggagaagcaggtgaaacttccactgccgaacaaaatcagaatgggagcagccatggttaataaggttgtggaagtttagascttccagttcacttcmcctt

SEQ ID NO: 134 - DNA, 660 bp, Homo sapiens
  repeat_region (1)..(660): pabl_a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggcaggccaggtctcactaacacaggcctccataacaactgtttcagcactgactgagtggttaagttaaatattaaaagctganagagccagtgcccttatacaaaggctggaatgtaacaaaagcccaccaagagttttgcctaggcctttcctgggccttgaagcatgacaaaataacgaaggaattcttaacaggacccgtttaggattaaacaagttttactgggggtctgaagaaactccccaggcctccacaaacaagtttattgggggtctgaaggaactccccaaacctccgtgatttagcaggagacaagataagggtaatcaccccagcacctggacccatttagattaagtaaatttactgaggctccagaggaaggtcttcaggactcagaccttagttatagattagaagaagttaatcacttatgtctttagatgaatgcacacttacacgtagacatatagcttagaaggtatataagctctggaaaactttgtaattttgagttggtctggtgataatttccaggccttctccctgtaaccggttacagaaataaaaactctcttcctccccagttcatctgcatctcgttattgggccacgagaaatagcagcccgaccctcagtttggtccgggaaca

SEQ ID NO: 135 - DNA, 667 bp, Homo sapiens
  repeat_region (1)..(667): pabl_b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggcaggccaggtctcactaacagctgaacaggcaggcctccatgacaactgtttcagcactgactgagtggttaagttaaatattaaaagctganagagccagtgcccttatacaaaggctggaatgtaacaaaagcccaccaagagttttgcctaggcctttcctgggccttgaagcatgacaagataacgaaggaattcttaacaggacccgtttaggattaaacaagttttattgggggtctgaagaaactccccagacctccacaaacaagttttattgggggtctaaaggaactccccaaacctccatgatttagcaggagacaagataagggtaatcaccccggcacctggacccatttagattaagtaaatttactgaggctccagaggaaggtcttacaggactcagaccttagttatagattagaagttaatcacttatgtctttagatgaatgcacacttacacgtagacatatagcttagaaggtatataagctctggaaaactttgtaattttgagttggtctggtgatattttcccggccttctccctgtaaccggttacagaaataaactctcttctttcccagttcatctgcatctcgttattgggccacgagaataagcagcccgaccctcggtttggtccgggaaca

SEQ ID NO: 136 - DNA, 90 bp, Homo sapiens
  repeat_region (1)..(90): pmerl
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tagagcagtggttctcaaccttcctaatgccgcggccctttaatacagttcctgtgggtcgcgacccacaggttgagaaccgctgctata

SEQ ID NO: 137 - DNA, 7756 bp, Homo sapiens
  repeat_region (1)..(7756): prima41
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tctttctggcgaaccacggaagggacgatactgaagaaaccccccgaacccaaaggaaatagactgcagcactgattggacgactttgggtaagtggtgggggtatattctatacccgggtaaagaatgggattgggttagaggcccaacttaggggagttagagtctctcctaagacagagtgggttagaggcccctcttaataaaaggcaaggacgcttgaccgaccttgggttagaggcccaacttaggagggttagagtcccttctaagatttagggggttagaggcccctctcggtaaagtccctctcggctaaaaatgggtttggcactgcaggatgtttatcgctatgctctttggattaatttgccttgtcctccttgctkcmtgaatcaatttcttggttgctgtctctgtttcactgtcattttcaggagactttatttaactggtcttagggattttaacttactcttttcctatgtgcctcctgatttccgtctgtctgcttgtgaaacattgggaacaaaaagcattgaaggctctgtctctaaaattgctgattgagatttggtatttaacagctatgagcaataaaattagacagatgtggttatgttttgttgccgctatgccgactaggtgtgatcgagaagcactaggatggaaatcaggggacttttctccttgctgttttgtttcattttgcacactaaaaaaacttctttcctttcttggattcaggcaaaccggctttgcttgttcaatccacactgccgctattgcccagaacctgcttgctctggtcattcccatctaaatcctcttcatttcctttgccttatttgacatttttgtcaaagtccatgttgtggtttatctaagattcatggctcggctcacttatgttatttggataatgtgaataagggaattcaattttcagcaggttttccgtcataatgcagcgtgccttaagaactgtctcctttttgatggaacttggccaatggcaatacagtctcacgggtttggaagttttctttcaacgtcatctgcctcctttatggggaatacagcatggatcccagaggactcaccactaggatgtattcttgaacattgggacaagtttaaaccaaatggacttaagaaaagaaagttggtggtttcatataatactgtctggcctcaaattactatacttggaaaaataagaaaaatggtcaactaccagaactatggcctttaatactatacttccacttgatttgttttgtaagtgtgagggcaaatgggataaaaccaatacgttcaagcatttttattgcccagtcaaaataaaactctgcaataggtatgtgcatgtttgatgagaggaaaggaaggaaaataagaaaaagaactagacatactagatgatcctttaatgcaagcccccctccccgcccccgccaaccttggttcagcaggcagttttgggtggagcagaacctccttctgtcagctctgatggttcagatgtgttggcctcttcttctagcccctctgaaagttctgttgagaaccctttgtcccctcctccttacccgtctagtcccactctatacccaccactccctgaggaacttagcccagtgagtactactcgtagtggagcctcctatcaacttccaaagggaaatctttgtccacttagagaggtggcaaatggggaagaaggcactgtgagagtacatgttcccttttctatgtctgatttgactctatgtaaagagaagtttggtcatttctctgaagatccaggaaaattcatagatgagtttgagaaattaactctgacctataatttaacttggcaggatctgcatgttttgttgtctctgtgttgtacagtggaagagaaacaatacattttggggacagctaggacccatgcagatgaggtattggctcgtaacccgaaccataatatatatcaggcaggaggtatagcagttccagatcaagatccagagtggaactatcaaaggggcagtgaggacttggggaggagagatcatatggtcacttgtttgttggaagggatgaagaaatgtatgaaaaagcctgttaactatgaaaaggttaaggaagtttctcagggcaaagatgagaatccagctttgtttcaagggcatttagttgaggcaatcaggaaatatactaacactgatcctgcctcaagggaaggacaaacccttttgggagtacattttataacccagtctgcccctgatatccataggaaactacaaaaagcagctatgggtccccaaactcctatggaacagcttttggatatggcatttttagtttttaataacaaggacaaagcagaggaagcagaaagagcaagaaggacctcccacaaggtgcagctcttggctgcagccttaagctcacctcccacatggggttgccctcctggctcttggcctgaacaagggaagctgaaaggtgggaagcccaaagctgggcgtccgagtcaccgtgccttgggcacgaatcagtgtgcacactgtaagaaaactggccattggaagagggatttcccagtgttctgaagggagccatcggcacctgaaccaatgatggccgaaatagccaggcaagcccaagagtgatggggcctcagaccttccaccacagctcccatcggacaactagccatatctccggagaagcctcgggtaacccttgacgtggcaggtaagaatattaacttccttctggatacaagggctgcttactctgttttgacccattataatgggactctgtcaccccaaaactgtatggtcatggggatagatggacaagctcatagatgccattttacctatcctttaagctgctcttcagggactttggttttctcatatgccttttcttatcatgcctgaatgccccaccccttgttgggaagggatttgttaactcagctgcaaacagtagtatcttttggaaatcacaaggcagacaaaaaattgctccttctcctttcctgtgataagggaggaaagtcaatagggacttatctagcttgcctattgaagtaacctcccaaataaatcctgtagtatgggacattgaggttccagacaaagcattaaatgttcctctggtttgcatttagcttaagcctgatgccctgtactcctggaagagacaagatcccctaaaaccagaggcataaagagggattcatccattaagaactaagtttttgcaatttggtttgttaagaccctttaagtttccttgtaatactctaatcttgccaattaaaaagccaaatggagactatatatttgttcaagatctttgagctgtcaacagtgctgtcattcccaaacatcctgtagtactcaacccctacatgctgttagcccaggtccttggggatgcaagttggtttacagtcttagatctcagggattttttttttttctgcatttgagtataccctgattcaaaatttatctttgcttttggatggactgacccttgatagtcatttggtttctcaattaacttggatggtttttccccaggagtgtagggacagcccacatttatttggaaatacattgactagagaattaaagatgttaaaattgaataggggcactagtatttggtatgtgaatgatttgttggtagctagcccaactaaaaggggctcaaataaaaatgccattaagttgctaaattttctggacactaatgggtatagagtgtcactgcataaggcccatgtttcaactcaagaagttaaatatttaagatatgtcttaacccctggcacctgggcaatagcccccagaaaaaaaggaagtgatcttgggaatcctggaaccccaaaccagaaagcagctatgggatttcctaaggatgggaagattctgctcttaatgagtgcctggatttgggcatatggccaagtctttatgtaaggctctaaaaggagcacacgtgatctttttgaatgcagtatcaattgtaaaacatacttttaatactctcaaggagaaactgggaacaactccagccctagggatccccaatcttgataagccatttcctttatttggctgaaaaacaaggaacgctctggaagtccttgtccagaaactgggaggcatccctgaccagtagcatatttttctaagtaattagaccatgtagctttgggatggcccagatgtctcagggcagttgcagcaatggctcttttggtatatgaagccaataaactggctttgggacaacatctggaggttttgaccccacaccaagtacaaggagtactagaagctaaaagacaccagaggatgactgggggacatgtatataaatatcaggctttgttgctaaacatcctgatataactcttaaagtatgccagactttgaatccagctacctatttgcctgaacccacaggcaccctagatcattcttgcatacaagttatggagcaagtttactccagctgtccggatttaaaggatgagcctctagataatcctgaggtagaatggtttacagatggaagtagctttgtgcaccagggaaacggaaaagctgggtatgctgttgtcagtcaacatgaggtaattgaatctcaggccttaccggcttctacctcagctcaaaaggcggaattaatagctcttattagagccctgcaattgggaaaggacttaagaattaacatttccactgattctaagtatgcctttctggtacttcatgctcatgctgctatctggaaggaatggggactcctaactgctaagggttcccctataaaacatcacttagaaattcggaatctgttggacgccgttttgctgcccaaggaagtagctataatccattgcagaggtcatctgaaagggaactccagtgtgactaagggaaactcctttgcagatgcagctgctaaggccacagcattaaaggatccagttggacttgttggtatgttggtgccctcagccacggtaataacagaaccgagatatactaaagaggaacaagaatgggctaaaggtcagggtttaattcaagatccttctggctggcttatcaatgacaacaaactgttgacaccaggtgctaatcagtggaaaatagttaaacatttgcatgactctactcatttgggaagagattccctgtttcaattaatgtctcagctttttataggaaaaggcttacttaaaacagtaaagcaggtaactcaggcctgtgaactatgtgcccggaataacccaaataaccaatctttacctcctcctctagtaaggcctgttcagcacaggggaacgtaccctggtgaagactggcaaatagactatactcagatgcccccatgtaaagtgtttaagtatttattagtatttgttgacaccttttctggttggatcgaggcttttcctacctggtctgaaaaggcaattgaggtttctaaactcctactaaaggaaataattcctagatttgggctgcctaagagcttgcagagtgataatggcccatctttcacagcgacaattacccaaaacatatcttcagccctaggaattcagtaccgccttcattcagcatggaggccacagtcttcagggaaagtagaaagagctaatcaaactctaaaaaggactcttgctaaactatgccargaaacatcagaaacctggctgtctttattgcctgtggccttgttacgggtttaaatggcccctaaaggaaatctgcagctcagtccttttgaaataatgtatggaagacctttcttaactacagacttcctaatagacatagatactttcaagctacagaattatgtgatcaacttaggacaagtgcaaaacgcactccttgaatatggaaatcaaagactcccttcccccactaaggaagagaatcttgttacaacccagccgggagactgggtcctattaaaaacttggaaggaaggatccccagcagatcaactttcccccaaatggaagggatcctatcaagttctccttagtaccccaactgcagttaaacttctgggaataaacagctgggtccacttatcttgaattaaacctgtctcttatgaagtcccacaggccagtggaacacaagagactgatcccgtttattcctgtgagccaatcagtgacctctgactcctgttcagaagaaacgaaagggatgggtaacataaagatatggattggcattctacttttgggtataagttggaatcatgcagagagtaacttatttactgagtgggcacagactttagcctctctacataatcagacaaactgttgggtatgtggaaaattaccactttcctccacttccggattgccctggcatattcaaccggccaacctaagtttgtgggggactttattatgattgggaaactgaaaataataaacatacaccctctttccccatgcgctatagcttgtgtggcctaagcccatttcctctcatgcggagagacaagaaggvaccttttttttttgtctaattaggaaacagctaaattccaccccaacttaggttatactgtacagaatggacttgggtggatgacaggtatcaggcaaagcacctctatgttttgaaaggcacaataatagtcaccaccagactggaacccgtgatatgggatggttgccacctcaacaatgtaatcagacccttcttttaacagaccagatgtggatgggatggcaacataatttgccaaaaatgggtgcctacccttctccttggggatggttatgggcttgtagaactcatggctggccatacttaccttataactggactggaaggtgtatgtggggttgcccttatctcccgggatgtatcctcaccaaattggactctctgccatctaactgggaaattgtaaaggctcgccataggcgacaaaaacaagcatcttggtggttttaccccatggctatattttccccacaggcagctaccaaattavatattgagtgacaagttgaagcagcctcagccaagcacacagttgcagctttcaataatacatgccatgctgccttacccttacctaactgaggaaacttctcagattaggcaggtagccttacaaaaccgtatggctttggacattttaacagcggcccaagggggaacttgtgctttgatcaaaaccgaatgttgtgtgtatgtttcagactattcacatactattacccaggctatgaaagctttagacactcatatctctgccactgatgtgctatcagtcgaccctatatcggcttggttccaacaactgcccagttcttggaaagccttcctgtttagtttacttggaatgattttacttattttgctttgctgttgtggaatatattgcggttgtactctttgtgtaggaatgcaagacaagcttactcaatgctttcttaaattggacacttattaatcttccagatatcaccttttgtcggaactcggagttatgaacgaccctcaccataccgatgctttctgactgagctcctctctaccctgaatgcaagagaccctaatagttaggcaggaatatcatcgcccctattcagcctgaagaagttacagaagatggatcttcgtccctctgcaacccttaggattaagggtcttcttgtaaagggaggggggagata

SEQ ID NO: 138 - DNA, 630 bp, Homo sapiens
  repeat_region (1)..(630): ptr5
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagaggtggcagtgtgctggcagccctcgcagccctcgctcactcttggctcctcctcggccttggcgcccactctggccatgcttaaggagcccttcagcctgccactgcactgtgggaacactggccaaggccagagccagctcactcagcttgtggggaagtgtggagggagaggcgcaggcgggaactggggctcgatgcggcgcttgcgggccagcgtgagttccggtggttggtggcttggcgggccccagactcggagcggctggcctgccctgctggccccaggcagtgaggggcttagcacccaggccagcagctgtggatggtgcgctgagtctcccagcagtgctggcccaccccaccagcactgcactcgatttctcgccaggccttagctgcctccccgcaggcaggccttgggacctgcagcccaccatgcctgagtctcccctgctgccgccgtgggctcctgcgtggcccaagcctccccgacgagcactgccccctgctccccggtgcctggtcccatcgaccccaagggctgaggagtgcaggtgcatgctgcgggactggcaggcagctccacctgcggccccatgcaggaagccagctgggctcctgag

SEQ ID NO: 139 - DNA, 66 bp, Homo sapiens
  repeat_region (1)..(66): r66
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
acagagtgctgattggtgcrtttacaaacctttagctagacacagagcgctgattggtgcgttttt

SEQ ID NO: 140 - DNA, 2030 bp, Homo sapiens
  repeat_region (1)..(2030): ricksha
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gggtttggatcataatcccgaaagacacaatcccaaacgccataatcccgaatgttgaaatcccgaaagatcaaaatcctaaagtctaaatccctaaagtctaaaatccctaatgtctaaaatcccgaaaatcacaatcacgaaagattaaaatctcaaatattgaaatcctgaaagccgaattctggggaagggattagtgcgttttcggttgtacgcaggatagttgcatcatgttagttgcatcatgttaggtggcagaactattaccttgttattgtctttatttggaaattaagtatggtttaaggagacacgtatgggtgccaagttgacaaggagtggacttgtggacttaattttaggtgtcaacttgactggattaaggaatacctagaaacctggtaaagcattattttgggtgtgtctgtgagggtgtttccagaggagattagtgtgtgagtctgagcggactaggcggggaagatctgccctcaatgttggcgagcaccatccaatcggccgggggcccggagagaacaaatacagaaggcgaactggtctctctctgagagctgggacagatttttcttctgctgccttggacatcagaactctgggcttgctggctttggactccaggacttacaccagtcctnnnaaccgggtcctgaggctttcggacctcagactgagagttacaccattggcttccctggttctgaggcttttggacttggactgagccatactgccggcatcccagggtctccagcttgcagacggcctgtcgtgggacttctcagccaccataatcgcgttagccaattcttctaataaattccctctcatrtatatatatatcatattggttctgtctctctggagaaccctgattaatacagatttggtattggggaagccgaatatcattccttcttactgtattccttacaacataatagaagagatctgtgaaattgttccctcacaaaaaggctgtgataaaataagtggacgaggctactcaattgtgaaagataaaatttaaaagctaattattattggtgctgcaaaagcagaaaatcacttaattacaatggccgagcaataaccagcttttaaatggacagcatatacttacaaaatttgtagaccacaaccactctgcaaatacacatgcagcaagtgtcttgaagatggcaamartgaaaattcagtttaaaaatacawsaattscctgccaaattattcaatctgtatgacttctacttctttacacaaaatttatgctatgtatttcatcttcgcatcatttccaatactggaggtataaattgtgtagagacttttagagagttctaatttgttttatgcattttttgcaaatttgactccacgaaagtgcattatcacaatgttgactttgtgtgtaagcattgtgcatgtatgtaaaaacgttgaaacttcctcaataaatgaagagatgtcctttttgtacatctgcatttgtgaaagataaaatttctcaagatcttggctctttgggcgactgcatatgcggtggtgacccatcgcggtttttgatcgatctcgtcaaaagacttaggttgttcgtcacggtatttcagatgaccgcagttataaagctgggtgcacacaattaccaaccatagtgatatgcgtttatacatttccctttttgacctatttctttatgaatacggttcgtctgctcataactgttatacccgtgcgactgtcattagtatacctgagtgtttatgcttgcaaaaatatgtatgttattattgcctattttattgtgtaaagtggcctatgaagtgttctgtcatgtttttatatgtttctcaaataaatccccttttaaaaatgtaaataaattatcttttaaagaatttttaaattttttttcagaattatattttcgggattttgatctttcgggatttcaacattcgggattatggcgtttgggattgtgtctttcgggattatgatccaaaccc

SEQ ID NO: 141 - DNA, 42 bp, Homo sapiens
  repeat_region (1)..(42): SAR
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
acataaaatatcaaagtacatcaaatatatattttattctgt

SEQ ID NO: 142 - DNA, 470 bp, Homo sapiens
  repeat_region (1)..(470): satrl
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
agggagaggatgatattactcccaatatcacagggggtgtacaccccccctgtgatattgttcctaatatccagggggggagaggatgatattactcccaatatcacagggggtgtacaccccccccccccccccsyacaccccccctgtgatattgttcgtaatatccagggggggagaggagaggatgatattactcccaatatcacagggggtgtacaccccccctgtgatattgttcgtaatatccagggggggagaggatgatattactcccaatatcacagggggtgtacaccccccctgtgatattgttcgtaatatccagggggggagaggatgatattactcccaatatcacagggggtgtacaccccccccstacvcccacmccccctgtgatattgttcgtaatatccagggggggagaggatgatattactcccaatatcacagggggtgtacacccc

SEQ ID NO: 143 - DNA, 455 bp, Homo sapiens
  repeat_region (1)..(455): sn5
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cttcccttcagggacctcaaagtgaccagcttccccttgaagaatgactctccaaggcccaggagcccagcttctgggcctccaagccaggccatctggcgagggagtcggtggacgtgccctggcttcttccatgttgagttggtactacccaccaaggggggtagagaggcgagcagatgttgtctctggcctgtgtcttgttatcatggtgctgactaggcctggtacagggccctgatggggttgtcctgggtggtcacgggggtgatgagaagaagatgcagaatggattgctgtgaggatgaatgagacgactgtcagtacagacaggcacacggtgaagtgttcagggattcccctcagtagctgcccagacccaaaacctgactcctgagtcacgttactgtcccactatacgttaagaggagggaaagctgggtcgcgcaggtccc

SEQ ID NO: 144 - DNA, 1640 bp, Homo sapiens
  repeat_region (1)..(1640): sva
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ctccctctccctcaccctctccccatggtctccctctccctctctttccacggtctccctctgatgccgagccgaagctggacggtactgctgccatctcggctcactgcaacctccctgcctgattctcctgcctcagcttgccgagtgcctgcgattgcaggcgcgcgccgccacgcctgactggttttcgtattttgttagtggagacggggtttcgctgtgttggccgggctggtctccagctcctaaccgcgagtgatccaccagcctcggcctcccgaggtgctgggattgcagacggagtctcgttcactcagtgctcaatgatgcccaggctggagtgcagtggcgtgatctcggctcgctacaacctccacctcccagcagcctgccttggcctcccaaagtgccgagattgcagcctctgcccggccgccaccccgtctgggaagtgaggagtgtctccgcctggccacccatcgtctgggatgtgaggagcgtctctgccctgccgcccatcgtctgagatgtggggagcacctctgcccggccgccccgtccgggatgtgaggagcgtcgctgcccggccgccccgtctgagaagtgaggagaccctctgcctggcaaccgctccatctgagaagtgaggagcccctccgcccggcagccgccctgtctgagaagtgaggagcccctccgcccagcagccacctggtccgggagggaggtgggggggtcagccccccgcccggccagccgccccgtccgggagggaggtgggggggtcagcccccagcccggccagccgccccgtccgggaagtgaggggcgcctctgcccggccgcccctactgggaagtgaggagccactttgcccggccagccactctgtccgggagggaggtgggggggtcagccccccgcccggccagccgccccgtccgggagggaggtggggggatcagccccccgcccagccagccgccccgtccgggagggaggtgggggggtcagccccccgcccggccagccgccctgtccgggaggtgaggggcgcctctgcccggccgcgcctactggaaagtgaggagcccctctgcccggccaccaccccgtctgggaggtgtgcccaacagctcattgagaaggggccatgatgacaatggcggttttgtggaatagaaaggggggaaaggtggggaaaagattgagaaatcggatggttgccgtgtctgtgtagaaagaggtagacctgggagacttttcattttgttctgtactaagaaaaattcttctgccttgggatcctgttgatcggtgaccttacccccaaccctgtgctctctgaaacatgtgctgtatccactcagggttgaatggattaagagcggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgtgagaaacacccaagaatgatcaataaaaaaaaaaaaa

SEQ ID NO: 145 - DNA, 2111 bp, Homo sapiens
  repeat_region (1)..(2111): tarl
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gatcaacagtgaggaggtcccacaaggctaagtggggcaagtcggggacctaaggcagtagcaggaaaaccaaagaaaacaggcggagacttgagacagaggcaggaatgtgaagaagtccaaaataaaaatccctgcacaggactcttaggctgttatcatgcactatcagcctactcctccctatttttgtacaataagctctttacactgtatttcttttcaatgaagttatcttccatctttgtactgcctcttggtgaaaagctgtcttccaagttaataactgggacatcagctctctgcagtaatagctccttttcagttttaatttgcagaactgatggggattaataactggcgctctgactttaagtggtgcaggaggcggccagtaggggacgccagccgttacgccgggagcaagagggccctgcgtagtccccatctgcctgcatgtggcgtgcagccacgacaatggcagcaagagggcccggcagtgtgcccagctgccagcaggcgggtgtgctgccactataatgtgaggaagagggccctgcaatgtccctagctgccagcaggcggcgtgccaccactatactgcgagcaagagagccctgccgtgccccggcgccagcagggggcgctggacagcactgtaagcaagagggccctgcagttgtcctagtcgccagtaggggacgcaatggcagagcaccgtgggcaagctggtcctgtagtgcccggctgcaagcagggggcgcccgaaacgggcttttcagattactcaggttccactcgtctctgcgccgccggggacgtgtgtctctgcgcgtgcaccgcgccacccccgcgctccccgcccggcggcgcgcgactgtgcgactgcaacactccccgccaccctcagcccagcgacgtgcgtctctgcgcctgcgccgcgcctcactcccgcccgctcagcgacccctcccttccggggaggcgccggcgtgcgtctacgccctgcgccgcgtctccccaacagcggcgcgcctctctgcgcctgcgccggcgcgccgcgcctctctgcgcctgcgccggcgcgccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgccccgcgcctctctgcgcctgcgccggcgcgccgcctttgcgagggcggagttgcgttctctttagcacacacccggagagcatcgcgagggcggagctgcgttctcctctgcacagacttcgggggtattgcgaaggcggagcagagttcttctcaggtcagacccgggcgggcgggctgagggcactgcgagggtggagctgcgttctgttcagcacagacgtggggggcaccgtaaaggcggagcagcattcttctcagcacagacgttgggggtactgcctgcctttgggataactcggggccgcatcgagggtgaataaaatctttcccgtttgctgccctgaataatcaaggtcagagaccagttagaacggtttagtgtggaaagcgggaaacgaaaagcctctctgaatcctgcgcaccgagattctcccaaggcaaggcgaggggctgtattgcagggttcaagtgcagcgtcagaactcaaatgcagcattcctaatgcacacatgacaccctaaatataacaggcatattactcatggagggttagggttcaggttcgggttcgggttcgggttcgggtt

SEQ ID NO: 146 - DNA, 364 bp, Homo sapiens
  repeat_region (1)..(364): thelb
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgatatggtttggctgtgtccccacccaaatctcatcttgaattgtagctcccataattcccacgtgtcgtgggagggacccggtgggaggtaattgaatcatgggggcgggtctttcccgtgctgttctcgtgatagtgaataagtctcacgagatctgatggttttataaaggggagttyccctgcacangctctcttgcctgccgccatgtaagacgtgmctttgctcctccttcgccttcygccatgattgtgaggcctccccagccatgtggaactgtgagtccattaaacctctttyctttataaattacccagtctcgggtatgtctttattagcagcatgagaacggactaataca

SEQ ID NO: 147 - DNA, 1580 bp, Homo sapiens
  repeat_region (1)..(1580): thelbr
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gtaaattggtaccagtagagtggggcgctgctgaaaagatacccgaaaatgtggaagcgactttggaactgggtaacaggcagaggttggaacagtttggagggctcagaagaagacaggaaaatgtgggaaagtttggaacttcctagagacttgttgaatggctttgaccaaaatgctgatagtgatatggacaataaagtccaggctgaggtggtctcagatggagatgaggaacttgttgggaactggagcaaaggtgactcttgttatgttttagcaaagagactggcggcattttgcccctgccctagagatttgtggaactttgaacttgagagagatgatttagggtatctggcggaagaaatttctaagcagcaaagcgttcaagaggtgacttgggtgctgttaaaggcattcagttttaaaagggaagcagagcataaaagttcggaaaatttgcagcctgacaatgcgatagaaaagaaaatcccattttctgaggagaaattcaagccggctgcagaaatttgcataagtaacgaggagccgaatgttaatccccaagacaatggggaaaatgtctccagggcatgtcagagatcttcgcggcagcccctcccatcacaggcccggaggcctaggaggaaaaaatggtttcgtgggccaggcccagggtccccgtgctgtgtgcagcctagggacttggtgccctgcgtcccagccgctccagccatggctaaaaggggccaacgtacagctcgggccgtggcttcagagggtgcaagccccaagccttggcagcttccacgtggtgttgagcctgcgggtgcacagaagtcaagaattgaggtttgggaacctccgcctagatttcagaggatgtatggaaacgcctggatgtccaggcagaagtttgctgcaggggcggggccctcatggagaacctctgctagggcagtgcggaagggaaatgtggggtcggagcccccacacagagtccctactggggcactgcctagtggagctgtgagaagagggccaccgtcctccagaccccagaatggtagatccaccgacagcttgcaccgtgcgcctggaaaagccgcagacactcaacgccagcccgtgaaagcagccaggagggaggctgtaccctgcaaagccacaggggcggagctgcccaagaccatgggaacccacctcttgcatcagcgtgacctggatgtgagacatggagtcaaaggagatcattttggagctttaagatttgactgccccgctggatttcggacttgcatggggcctgtagcccctttgttttggccaatttctcccatttggaatggctgtatttacccaatgcctgtacccccattgtatctaggaagtaactaacttgcttttgattttacaggctcataggcggaagggacttgccttgtctcagatgagactttggactgtggacttttgagttaatgctgaaatgagttaagactttgggggactgttgggaaggcatgattggttttgaaatgtgaggacatgagatttgggaggggccaggggcggaa

SEQ ID NO: 148 - DNA, 2418 bp, Homo sapiens
  repeat_region (1)..(2418): trigger1
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggcatacctcgttttattgcgcttcgctttattgcgcttcgcagatactgcgttttttacaaattgaaggtttgtggcaaccctgcgttgagcaagtctgtcggcgccatttttccaacagcatgtgctcacttcgtgtctctgtgtcacattttggtaattctcgcaatatttcaaactttttcattattattatatctgttatggtgatctgtgatcagtgatctttgatgttactattgtaattgttttggggtgccacgaaccgcacccatataagacggcgaacttaatcgataaatgttgtgtgtgttctgactgctccaccgaccggccgttcccccgtctctctccctctcytcgggcctccctattccctgagacacaacaatattgaaattaggccaattaataaccctacaatggcctctaagtgttcaagtgaaaggaagagtmrcacatctctcactttaaatcaaaagctagaaatgattaagcttagtgaggaaggcatgtcaaaagccgagataggccaaaagctaggcctcttgcgccaaacagttagccaagttgtgaatgcaaaggaaaagttcttgaaggaaattaaaagtgctactccagtgaacacacgaatgataagaaagyaaaacagccttattgctgatatggagaaagttttagtggtctggatagaagatcaaaccagccacaayattcccttaagccaaagcctaatccagagcaaggccctaactctcttcaattctatgaaggctgagagaggtgaggaagctgcagaagaaaagtttgaagctagcagaggttggttcatgaggtttaaggaaagaagccatctccataacataaaagtgcaaggtgaagcagcaagtgctgatgtagaagctgcagcaagttatccagaagatctagctaagatcaytgatgaaggtggctacactaaacaacagattttcartgtagatgaaacagccttctattggaagaagatgccatctaggactttcatagctagagaggagaagtcaatgcctggcttcaaagcttcaaaggacaggctgactctcttgttaggggctaatgcagctggtgactttaagttgaagccaatgctcatttaccattctgaaaatcctagagcccttaagaattatgctaaatctactctgcctgtgctctataaatggaacaacaaagcctggatgacagcacatctgtttacagcatggtttactgaatattttaagcccactgttgagacctactgctcagaaaaaaagattcctttcaaaatattactgctcattgacaacgcacctggtcacccaagagctctgatggagatgtacaaggagattaatgttgttttcatgcctgctaacacaacatccattctgcagcccatggatcaaggagtaatttcgactttcaagtcttattatttaagaaatacattttataaggctatagctgccatagatagtgattcctctgatggatctgggcaaagtaaattgaaaaccttctggaaaggattcaccattctagatgccattaagaacattcgtgattcatgggaggaggtcaaaatatcaacattaacaggagtttggaagaagttgattccaaccctcatggatgactttgaggggttyaagacttcagtggaggaagtaactgcagatgtggtggaaatagcaagagaactagaattagaagtggagcctgaagatgtgactgaattgctgcaatctcatgataaaacttgaacggatgaggagttgcttcttatggatgagcaaagaaagtggtttcttgagatggaatctactcctggtgaagatgctgtgaacattgttgaaatgacaacaaaggatttagaatattacataaacttagttgataaagcagcggcagggtttgagaggattgactccaattttgaaagaagttctactgtgggtaaaatgctgtcaaacagcatcacatgctacagagaaatctttcatgaaaggaagagtcaattgatgcggcaaacttcattgttgtcttattttaagaaattgccacagccaccccaaccttcagcaaccaccaccctgatcagtcagcagccatcaacatcaaggcaagaccctccaccagcaaaaagattacgactcgctgaaggctcagatgatcgttagcattttttagcaataaagtatttttaaattaaggtatgtacattgttttttagacataatgctattgcacacttaatagactacagtatagcgtaaacataacttttatatgcactgggaaaccaaaaaattcgtgtgactcgctttattgcgatattcgctttattgcggtggtctggaaccgaacccgcaatatctccgaggtatgcctg

SEQ ID NO: 149 - DNA, 2718 bp, Homo sapiens
  repeat_region (1)..(2718): trigger2
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagttgacccttgaacaacacgggtttgaactgcgcgggtccacttatacgcggatttttttcaataaatatattggaaaattttttggagatttgcgacaatttgaaaaaactcgcagacgaaccgcgtagcctagaaatatcgaaaaaattaagaaaaagttaggtatgtcatgaatgcataaaatatatgtagatactagtctattttatcatttactaccataaaatatacacaaatctattataaaaagttaaaatttatcaaaacttacgcacacacttacagaccgtacatggcgccattcgcagtcgagagaaatgtaaacaaacgtaaagatgcagtattaaatcataactgcataaaattaactgtagtacatactgtactactgtaataatttcgtagccacctcctgttgctattgcggtgagctcaagtgttgcgagtatccgcttaaaacgccatgtgacgctaatcatctccgcgtgagcagttcgtctctccagtaaattgcgtatcgcagtaaaaagtgatctctcgcggttctcgcgtatttttcatcgtgtttagtgcaataccgtaaaccttgaataacaccatgggacccatacgaagtgccactagtgatgctggaagtgctcccaagaagcagagaaaagtcatgacattacaagaaaaagttgaattgcttgatatgtaccgtagattgaggtctgcagctgcggttgcccgccatttcaagataaatgaatccagcataaggaccattgtaaaaaaagaaaaggaaattcgtgaagccgtcgctgcagctatgccagcaggcgcgaaaaccttgcactttttgcgaaatacctttttatctcgtattgaaaatgcagcttttatgtgggtgcaggattgctataagaaaggcatacctatagactctaatatgattcgagaaaaagcgaagtcattatatgacaacttaaagcaaaaggaaggtgaaggatctaaagctggagaatttaatgccagcaaaggatggtttgataattttagaaagaggtttggcttnaaaaatgtcaagataacaggagaagcagcttctgccgaccaagaggcagcagacgagttcccagatgccattaagaaaatcattgaggagaaaggatatctgcctgaacaggtttttaatgcagacgaaagtgccctattctggaggaaaaaaatgccacaaaggacatttattagtaaggaagagaagcaagcaccaggatttaaggcaggaagggataggctaactctactgttttgtgcaaatgcagtcgggtttatgatcaggactgcccttatctataaagctgctaacccccgagccttgaagggaaaagataaacaccagctgccagtcttttggttgtacaacaagaaggcctggacaacgagaaccctttttctggattggttccatcgatgctttgtccctgaagtcaggaagtaccttgccagtaagggactgccttttaaagttcttttgatattggacaatgcccctggccacccagaaccccatgagttcaacaccgaaggcgtcgaagtggtctacttgcccccaaacacaacgtctctaattcagcctctagatcagggggtcataaggacctttaaggctcattacacacggtactctatggaaaggattgtcaatgctatggaagagaaccccaatagagagaacatcatgaaagtctggaaggattacaccattgaagatgccatcgttgttacagaaaaagccgtgaaagccatcaagcccgaaacaataaattcctgctggagaaaactgtgtccagatgttgtgcatgacttcacaggatttacgacagagccaatcaaggaaatcatgaaagagattgtggatatggcaaaaaaggtggggggtgaagggtttcaagatatggatcttggagaaattcaagagctaatagacaccacaccagaggaattaacagaagacgacttgatggagatgagtgcttccgaaccagtgccagacgatgaggaagaagacgtagaagaagcagtgccagaaaacaaattgacattagacaatctggcagaagggttccgattattcaagactgcttttgacttcttttacgacatggacccttctatgatacgggcactgaaactaaagcaaacggtggaagaaggattggtaccatatagaaacatttttagagaaatgaaaaagcaaaaaagtcagacagaaattacgatgtatttccataaagttacaccgagtgtgcctgcctctcctgcctccccttccacctcctccacctcttccgcctctgccaccctgagacagcaagaccaacccctcctcttcctcctcctcctcagcctactcaacgtgaagacgatgaggatgaagacctttatgatgatccacttccacttaatgaatagtaaatatattttctcttccttatgattttcttaataacattttcttttctctagcttactttattgtaagaatacagtatataatacatataacatacaaaatatgtgttaatcgactgtttatgttatcggtaaggcttccggtcaacagtaggctattagtagttaagttttkggggagtcaaaagttatacgcggatttttgactgcgcggggggtcggcgcccctaacccccgcgttgttcaagggtcaactg

SEQ ID NO: 150 - DNA, 2302 bp, Homo sapiens
  repeat_region (1)..(2302): trigger5
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagatggttcccaacttacgatttttcaactttacgatggtgcgaaagcgatacgcattcagtagaaaccgtacttcgaatttctgatcttttcccaggctrgcgatatgcggtacaatactctgtcgcgatgctgggcagcgrcagtgarccgcagytcccagtcagccgcgcgatcacgagggtaaacaaccrrtaytctacagtgtaytrtrtgactggcgtttcttggacattgtgtttcgcgcttttgcatcctgtcatgtctacagtatgctcatctatgcctcctgcttctggtgagaagaagaggaaggcaattactcttgagatgaaactcaagataatcgccctgcatgaagacggcaagggattaatggccattgcacaagagttgggactttcacgatccatgatcctcaaccatcttaaagaataagaagtgaatcagtgaggcagtgaaatcgtcagcattagttaaatccactgtcacgaagaaaagagcttggctgattgataatatcgaaaaattacttgtcatgtggatgtaagaccagatatcgaagggcatactacttactgatgatgccagctagggcaagaagtgtttttgattacactaaaagagtgaatgaatgtgtcgatgatcctattatacacaagtgtttatggcaagtcataggtgattccagtgcttcaaaaggcatcataattttcttaatgtgaaggtcagcagagagtcagcaagcgctgatattgaatgtgtcaaagcttttaggaagagctgtacacgataattgtggataataaatatttcccaggacaaatattttatgtaaataaaatagggttgctctggaagcaacctgtcaagaacttaaggcattcagactgtgtattgctgcttttgggtggaaatgttgcagggttcaaattaaagcttttcctaatttacaactcagggaacccaagaacactcaagaatgtgagcaagcattcgcttcttatttattatcaccataacaagacaccctggaggacctcagcattgttcgaagactggcttttgaactgttttcttccacaggcaagagaatattgtaagcaaaaaacgacttcattcaagattcttctgatcttagacagtgctccagggcacccacagcatataggtgacatgcattcttatggaaagttatgagtttgctgccaaacacaaccacactcaactcatggaccaaggcacaatagctgcattcaaagcacactatgccaggcatttgctccggctgttgaagtgaatgaatctggctgaatgctcctagagttctggaaaagttttaacattctaaatgctatccagaatatcactggagcatggaaagaagtcacacagcaatgcatgaatggcatttggaaaaaagttttgaagacatgtgaacacattcaaaggccttagcaaggttctgctgttgatgaaacagtaacaagatactagtgcttggagaatagctagaattgatgaagaggatatttattaacttcttggcattgaatctgaagagctttccaatgaggagataatcaaactggaggaagaaagaagttgagaaagaggaagaagttatacctgaggcaccaagaaagttaacggcaaagaaactggcagagatatttgccactatcagcagtgccattcagaagttagaagaaagggatgtcattattcacaggagctgacacacagtacaggatgctcttgcttgctacagagaaatatataatgaaaaggagaacaaactgtatagtccaaacctgatgtcttcctgaagaacactatgcctgctaaaccattaacaagtatcgatgccccagtgccttctcccagctactctcaggcctcatcagaagagaaattaatgaccctgttgcagtagcatccccatcatccagcaattaattttagttcaatgcttcaaacattcttcaggcccagtatgcattcacctgtgtatgttacttaattgtgagtacccatacaaccatactgtttytyactttcagtacagtattcartaaattacatgagatattcaacactttattataaaataggctttgtgttagatgattttgcccaactgtaggctaatgtaagtgttctgagcatgtttaaggtaggctaggctaagctatgatgttcggtaggttaggtgtattaaatgcattttcgacttacaatattttcaacttacgatgggtttatcgggatgtaaccccatcgtaagtcgaggagcatctg

SEQ ID NO: 151 - DNA, 2806 bp, Homo sapiens
  repeat_region (1)..(2806): zombi
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggttgagcatccctaatccaaaaatccgaaatctgaaatgctccaaaatctgaaactttttgagcgctgacatgacgccacaagtggaaaattccacacctgaccttatgtgacgggtcacagtcaaaacgcaggtgcacaacacacagtttattcggcgtccccaagggaaaaaagaccctcccagcccccttcagctgcggtatatcttttccgcgcacacccagattcccccatgcaagcacgcccacaaagggtaataaaatggcacgtgtgcaggctggacacaccaacggcaggttccccacaatgcccccacatggggtcaagacctacgtgcattactcactgtgtttttttgcttattctctgctctgtggtgtaaagatattgttgaaaatgtcaaaaaggcctgtagatacccctgtgagtaacaatgataagaaaaaggaagcatttatgtttatctatagcacagaaaagtcaagctgttggagaaactggacagtggtgtaagtgtgaaacgtcttacagaagagtatggtgttggaatgaccaccatatatgacctgaagaaacagaaggataaactgttgaagttctatgctgaaagtgatgaacggaagttaatgaaaaataaaaaaacactgcataaagctaaaaatgaagatctcgatcgtgtattgaaagagtggatccgtcagcatcacagtgaacacatgccacttaatggtacgctgatcatgaaacaagcaaagatctgtcacaatgaactgaaaattgaagggaactgtgaatattcaacgggctggttgcagaaatttaagaaaagacacggcattacatttttaaagatttgtggtgataaagcatctgctgatcatgaagcagcggagaaattcattgacgagtttgccaagatcatcgctgatgaaaatctgatgccagaacaagtctataatgctgatgaaacatcaccgttttggtgttattgccccagaaagacactgactacagctgatgagacagcccctacaggaattaaggatgccaaggacagaataactgtgctgggatgtgctaatgcagcaggcacgcataagtgtaaacttgctgtgataggcaaaagcttgcgtccttgctgttttcaaggagtgaatttcttaccagtccattattatgctaacaaaaaggcatggatcaccagggacatcttttctgattggtttcacaaacattttgtaccagcggcttgtgctcactgcagggaagctggactggatgatgactgcaagattttgttattccttgacaactgttctgctcatcctccagctgaaattctcatcaaaaataatgtttatgccatgtactttcccccaaatgtgacttcattaattcagccatgtgaccagggtatctttagatcaatgaagagtaaatataaaaacactttcttgaacagcatgctagcagcagtgaacagaggcgtgggtgtggaaggttttcaaaaggagtttagcatgaaggatgccgtatatgctgttgccaacgcttggaacacagtgactaaagacacagttgtgcatgcctggcacaacctctggcctgcgactgtgttcagtgatgatgatgaaccaagtggtgactttgaaggattctgtatgtcaagtgagaaaaaaatgatgtctgacctccttacatatgcaaaaaatataccttcagagtccgtcagtaagctggaagaagtggatattaaagacatttttaacatcgataatgaggctccagttgttcattcattggaagaagtggatatcaaagaagtcttccacatcgataaatgcattaccagttgttcaaccatcaccggatggtggaatagccgaaatggttctgaatcaaggtgattgtgatgatagtgatgatgaagatgatgacgttaacactgcagaaaaagcgcctatagatgacatggtgaaaatgtgtgatgggcttattgaaggactagagcagcgtgcattcataacagaacaagaaatcatgtcagtttataaaatcaaagagagacttctaagacaaaaaccattgttaatgaggcagatgactccggaggaaacattttaaaaagccatccagcagaatgcctcctcatccctagaggacccacttcctggtccctcaactgcttctgatgtttcttctcacttagaaaacaaaaaccaaaaagcaaaaaaaatacagtgtacagtaaccttttaatcaaaacacagcatcgtagatggagactgaaagcctgccattgtttgttgttgctgttgtttaacagctgatacaggtattctggtgatgctactgtgctgcttagttaccctgaacacatttttttttcactgtattaatggtatgtcatattttttactgttaagtacttatgtgtgaataagtgtaagaaaatgattgcttatcggtagcatataaattcagagtcaggaatgatggtgatgccaaacaaccacagattgtccacatgggtggctgagatagtgacacctttgctttctgatggttcaatgtacacaaactttgtttcatgcacaaaattattaaaaatattgtataaaattaccttcaggctatgtgtataaggtatatatgaaacataaatgaattttgtgtttagacttgggtcccatccccaagatatctcattatgtatatgcaaatattccaaaatctggaaaaaaatccagaattcaaacacttctggtcccaagcatttcggataagggatactcaacctg

SEQ ID NO: 152 - DNA, 234 bp, Homo sapiens
  repeat_region (1)..(234): zombi_a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggttgagcatcccaaatccgaaaatccgaaatccgaaatgctccaaaatccgaaactttttgagcgccgacatgacgctcaaaggaaatgctcattggagcgttttggatttcggattttcagatttgggatgctcaaccggtaagtataatgcaaatattccaaaatccaaaaatccgaaatccgaaacacttctggtcccaagcattttggataagggatactcaacctg

SEQ ID NO: 153 - DNA, 468 bp, Homo sapiens
  repeat_region (1)..(468): zombi_b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggttgagcatccctaatctgaaaatccgaaatccaaaatgctccaaaatctgaaactttttgagcaccaacatgatgccacaagtggaaaattccacacctgacctcatgtgataggtcacagtcaaaayacaatcaagactnnncnagcnnctncngttgctnttnctgccagncaacnacagnttgtgcacctngntggcaraganactgacacatttgctttctkatggttcagtgtacacaaactttgtttcatgcacaaaattatttaaaatattgtataaaattaccttcaggctatgtgtataaggtgtatatgaaacataaatgaatttcgtgtttagacttgggtcccatccccaagatatctcattatgtatatgcaaatattccaaaatccaaaaaaatctgaaatccaaaacacttctggtcccaagcatttcggataagggatactcaacctg

SEQ ID NO: 154 - DNA, 333 bp, Homo sapiens
  repeat_region (1)..(333): zombi_c
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggtccacaatcccttatctacaattctaaaatccaaaaagctctgaaaactaaaagtttttttataatttgaaactcatttggcagcaaaacctgacctgaactgatatgaggctatttatagtctttatttatcccacttagtgtgaatattcatatatttcactgcagaaatattaatgtgtttgattatagggtgctgccccagaccccactgggggtgttatataatatatagtatatgcactatattacctttctaaaatctaaaaaattctgaattctgaaacacatctggccccaaggatttcagataagggattgtggacctg

SEQ ID NO: 155 - DNA, 290 bp, Homo sapiens
  repeat_region (1)..(290): mer35
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gatgtggcgtttgagtggacacgggggaagaaacaagtaatatgaataacatggtgagacagaaagagttgtggacagagctgtgggaaatatgagagataaggagagagatactgaaaagagcgttaagagagatgaagatagggtgtctggcccatgaaggccctcgtgaagagcaatgctgaatagatgaatgaacctcaatgcccagcagtggtgggatgaaaaggggatcctgtgcagaaaccacactacccatcagagaagcaactctgctcgtttccccttga

SEQ ID NO: 156 - DNA, 693 bp, Homo sapiens
  repeat_region (1)..(693): mer39
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cataattccgggttctcagctcctataagccttgctgtttcctgagtgactaaaacnataagnatatcttttgttgaantatntggctttttgtccttggttcatgtagcagctttggaacagcttcagagcggtaaaggtganggacagncttttgttanaatgttggggcgctctaagcctcagaagcagncctcagraaacagaanntcattttctgaccttctctngccctctaatcwtymcccgcctttctgtcttrgrgctgsccgtaaagaaattwtctgacctatctcgtctgatwgtaggtcataagaccctcattccagaaggggtcccgccctatacccgggaggaaggaatgccgcacagakagaccaagaagaatacgaacagacaagccttgctgggttyccacacycagtytatkaccattagatcatwccccttttgtcyaatcacatttctgcgcagctntccattcttcatcaaatctaarcataaaaatagagttttccctgagtmtttgkgtcttcatttctgaaggctcycatgtcacataaaactttgattaaataaatctrttatgcttttctcttgctaacctrtnttttattataggagtgtnngccgtgacccttatgatgggtagggaaggnatcacacctttctgcccctacagnnntaatgccc

SEQ ID NO: 157 - DNA, 581 bp, Homo sapiens
  repeat_region (1)..(581): mer39b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tggttggggctcagaaaacaataccgcaaaatgaaggcctcagaagcaaartttttctctgaccttctcccgccctcctgtctctcagtcccattctcccctccccgaggctagccatagaaactagaatctctcttccccaaggcaggtcatagaaaccagaacycctttcctscaaagccagccataaaacctaaaaatattactctaactttccctccacctttctgtgtaaaaactggccataaagaaattatctgacctaccttgtttgattgtaggtcataagacccccattccagagagggccccgccctatanccggaaggaatgcgtgctcagagaagccaagaagaatctagacagacaggccttgctgggtttccccactcagctcattagcattrgatcatrgcctttttgtccagtcatatttctacacggctgtccattctttgttgaacctaagcataaaaatggacaattttccctgtatctttgggtcttcattctgaaggctcccgtgtatacagtgtatacatgttarataaatgtatatgcttttctccattattctgctt

SEQ ID NO: 158 - DNA, 554 bp, Homo sapiens
  repeat_region (1)..(554): mer41a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtcagagacgtgtgaaccagagcaactccatcttgaataggagctgggtaaaatraggctgaracctactgggctgcattcccagacggttaaggcattctaagtcacaggatgagataggaggtcggcacaagatacaggtcataaagaccttgctgataaaacaggttgcagtaaagaagccggcyaaaacccaccaaaaccaagatggccacgagagtgacctctggtcgtcctcactgctacactcccaccagcaccatgacagtttacaaatgccatggcaacgtcaggaagttaccctatatggtctaaaaaggggaggcatgaataatccaccccttgtttagcatatcatcaagaaataaccataaaaatrggcaaccagcagccctcggggctgctctgtctatggagtagccattcttttattcctttactttcttaataaacttgctttcactttactctrtggactcgccctgaattctttcttgcacragatccaagaaccctctcttggggtctggatcgggacccctttcttgtaaca

SEQ ID NO: 159 - DNA, 635 bp, Homo sapiens
  repeat_region (1)..(635): mer41b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtcagaggcgtttgaaccagagcaactccatcttgaataggcgctgggtaaaatraggctgaracctactgggctgcattcccagacggttaaggcattctaagtcacaggatgagataggaggtcggcacaagatacaggtcataaagaccttgctgataaaacaggttgcagtaaagaagccggcyaaaacccaccaaaaccaagatggccacgagagtgacctctggtcgtcctcactgctcattatatgytaattataatgcattagcatgctaaaagacactcccaccagcaccatgacagtttacaaatgccatggcaacgtcaggaagttaccctatatggtctaaaaaggggaggaaccctcagttccgggaattgcccgcccctttcctkgaaaaytcatgaataatccaccccttgtttagcatataatcaagaaataaccataaaaatrggcaaccagcagccctcggggctgctctgtctatggagtagccattcttttattcctttactttcttaataaacttgctttcactttactctrtggactcgccctgaattctttcttgcacragatccaagaaccctctcttggggtctggatcgggacccctttcttgtaaca

SEQ ID NO: 160 - DNA, 554 bp, Homo sapiens
  repeat_region (1)..(554): mer41c
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtcagaggcgttcgaaccagagcgactccatcttgaatgagggctaggaaaatgaggctgagmcttgctgggctgcattcccagraagtcaggcattcctaacctctagatgtttacggttaagggaacagattaataatgtttactaaacagacccagacttgggagtgtccagatatcccgatatctkgagaacagaggcattcctaatttckctttaaagataataatattgattcttgcaaaakatagtaattaagcaaagatkrrcaatcctttgtcacaagcccttgtagcagagcacatctcccccgtaatgttctttggctttgttatcctatatataaacaagcattgtacctagggtggacgcsttcctcctsttgctttcgggaacgccctgctctgtctatggagtagccgttctttcactmctttactttcttaataaacttgctttyactttacactgtggaatcaccctgaattctttcttgcatgagatccaagaaccctctcttggcggttggatcaggacccctttcttgtaaca

SEQ ID NO: 161 - DNA, 557 bp, Homo sapiens
  repeat_region (1)..(557): mer41d
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttagggaagcaggagcctaggagagccagagtgacaccattttaaaatcaactccatcttaaaactagcaaggcacattccttgccagtcacgacccatggtcctaagatgtttacagttgaggaagcagcttgawaatacctacaaggacacactcctacaacaacagaaagtccagatgtcccaatacccataacaatatatgctttcaagataattatagtcatgctttgatgtacttacgcactaaaatgtcaaagatagttttctttaaatcaatatamtaataaattttgtcatgctgtcagcccacccgcacgtaggcacagcttagtttagtctttacatagacaagactcctatataagaaaagtttaagacagagatggcgcgttcctccgcctnctttccggggacgccctactctgtaatggagtagtttttaataaacttgctcttctcactgtactccgcaactcgccttgaattccttcctgtgcgagatccaagaaccctctcttagggtctggatcgggacccctttttctggtaaca

SEQ ID NO: 162 - DNA, 512 bp, Homo sapiens
  repeat_region (1)..(512): mer41e
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaaatagctgcataagctatgggccgataagaccctgaaaaaccagggtgtggaccaagctggctaagactgactggacccaacatggtgctggatttgacctaggtttcacctaggacctcattatatgctcattaacatactaaatcacacacccaccagcaccatgacagttccgggaacacccatatttggtgtaaaaatgggtggcaccacagttctgagaaatcttcacctttttccaggaatcttcatgaatattccaccccttggttaaagaaacccataaaggtagaagccccaaacccymttggcgcaactcwctctcttgagtatgcccgcactcccctttcttgagtgtgtacttttcgctttgcaataaatctccgtactttcactattttctgactcatccttgaattccttctcgcgatggtgtcaagagcctggacaccggctggggtcgasgtcccaccggcgtttggggacctcccccagcccaccggtatca

SEQ ID NO: 163 - DNA, 3943 bp, Homo sapiens
  repeat_region (1)..(3943): mer41i
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tctttctggcaaccacagaagggactacagtgcagaaaccctcaacccaaaggctaactttgagtaagtgatagggtcctgtaacatctttctggcaaacccaaaaggacaatactgaagaaacctcccaatgcaaaggaaatagactacatcattgataggccgaccttgggcaagtggtggggtacccaggtaaaagatgggattgggttagaggcccaatttagggaagtttgggtctctgctaagacagactgggttaaaggcccctcttaataaatggcaaggatgcttgaccaaacttggtttagagggccaacttaggagggttagagtccttcctaagatttaaggggttagaggcccctctcagtaaagtccctcatggttaagaacgggtttggcactaagggatgttaactgccattctctttggattaatctgtgttgcactctttgctgatggctatgggtgacaggattaggcatgtgatcctgtgatcacgggacatgaggagctttttcttccctaaaaggggaaacttcagagctgctgggcctgctggaaaagatcccttctcaactgacaagtgaccgcctgaacttttgattcagtgtctgctgcaatgggcaggtctttctctggtctccctgagcgccttgccttccccaccctgccataagcagtgcttttctcccttccctttccyctctctstctgtgcaaaccggttaaacraacgataaaaatcactgtttatctcctctgtaaagttttrattaatrgaaaaaaggatttttgaggctagtcttaagctgtagcgaatctggtgtrctttgtgtgtctttctgtatngttctgtcataaaraggggtaccttaggatagaacgcwggctkaggacmcycgtaagctcactgttcaacccagcccagcaaactggtcagttataaattttgctgcaggtccctgaaacaacaacaaaaaantggatgaggtttccctcccatcttgttttatgtccttggragcttgaccttgtaaccatgtggcgrtrctttcgcttggyctctgccatcacaatggcgtcccgggttcaggrttcwattcctgnctcagrrgatgagtttctttatattcttctgtctatgtatttatatgtgttgtgtgtrtgtgatgtttatatatraaagagctntrattaattggcttaaaraataagaagagcttaaatcaaatattttgtcagaaaartaraargtstartgccttttagttcacgtgactttagtaatctttgrkaaataaagacagtttaaagattattgrtaaaataaaaatgtcttcaaaayttaatktaracatttggtctraattagrcaggtcagatactatstctactagatgytttaaggtcataaactgcttctatgacttttgataatttttyaacttgcytgctttanagccattngattctaggtaaggcctggggacatgtggagttagccacgtcccctagctatgctggagagtcagactttatctgcgcttctgcctggtgtgtccaaggctaggctccacacctagtacataattaaaatcacttactaaccaggtttttcaccaaaagtaaaagttcttaagagttaacattgtaacatgtaattaagactactaaagaaacagttccacaagtaagtcctataaggaaagtgaaatgtgtttttggttaaaaaaaaattataagaagtcacgggagtatgagttttctttactttgcctaaagggttagaggattattttaagttagatagaataaagctgaaggtttaagcaagttgtggaaggtttatttaaaaaattaattgtaagagattttgtgtgtgaatatattggctaaagttgaaaaggcattattcagtttttccataaattaaacattggaataaaagcaaaacaggtttttgttagagcaaaaacctgcttatgacctgctttttaacaaacatttgtaaaggattataaaaggtttatgagaatgttaccttatggtcaaacattaaaattgggtagatatgtctataaggttttattaagaattgggtttgacatcaataatacactaatgcaacagtgacatttggctgatttagtataaaagtcatagaggaagcatcatcaaatatgaaatggtgtttggctttctttgggctgtatttgtataaatgtgtcattggtacatgttccaaaattattttaaaaaaaacttctttaaccctgatatgacttagtgtatgctattaataattgttatgnnnnnntaaattattgcgtgccacagaggtaacaaattttccttgtcaattgtgtctttaactgtggctgtcctaagactttttgtcatccatagacaattgttgtcttgttttggtcctctttagaaggtggtttataatcagctgtagaactctaacaggtgctcttaaatgcaggtttctgataactttggagattgtgacattagaacggaggaaaaacattcaggactcatgaagagctgaaatrttcatgaatatcaagcagaacagggagttaactgcatggactgaactaanagaagtctaacgtgtaaaacgttgctgatcctttgttttgtttttcagagtcaaggaaactttttcttttgagctatttacagcttttagcaattgagtaaagtatactyctgtgaacaaaatttggagcatrtttgtttctctctacctgatttctccagaatttggaaactattcgtgagtattctcaatttatggcaatatagttatttgcataagtgcaataagaatctgttytctttagtaacaggacacaattggagaaattggttattttaccaaggctttgactggaatggcatacttccctttaaggaatcaaanttgacttrycgagccgataaaagccccttggggaatctgrcctcataccttnttcayacgcagtccctgtacagggttcctgacctgtggtaagtaaagaatgtcactttctracaggcccagrarccccaagttatyttgrgacctcaagaggagaggaatttacycaactcataggtatttgakggtacaaanccatggctgggctcagctttaaaaaagtcttatccgagattccttctatgaaacaaagttccatcaaagccaattttaaaagcctatgtgaaaaataattattcttgctgcactktatacaaataatyaggccaagtataataaarcaaaycggtcctaccatgatttgtctttaryaaaaatggraaactggagagagaaaaattatgtttcaaaacctatagtacacytgttgttarattctartcttrcctaatgtttttcagttkttnttatnttctrcantttagactaactctacttattcctgtgaaccaaccagtgatctctggctgcwgctcagaagaaacaagrartgatgggtaatataaaaatccggatnntattctaattctgggcacgtattggaatcggctaacaaccccatatcagcttggttccaatagttgcccagttcatggaaagccttctaatttagtttacttgggataattttgcttattttgctttactnttgtggaatatattgctgttgtactctttgtgtaggaatgcaggataagcttactraatgttttcttaaaycgaacccttattcctcttccagggtaccatcttttgttgggaactcagttacaaataaccctcaccataccagtactttctggaatgagctcctcttctaccctggagggcaagagaccataatagtcaggcagaaatatcattgcccctattcagcctgaagaagttacagaagatgaatctttgtccttctacaaccttaggattaagggttcttttata

SEQ ID NO: 164 - DNA, 333 bp, Homo sapiens
  repeat_region (1)..(333): mer44a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagtagtccccccttatccgcgggggatacgttccaagacccccagtggatgcctgaaaccacagatagtaccgaaccctatatatactatgttttttcctatatatatatacctatgataaagtttaatttataaattaggcacagtaagagattaacaataactaataaaatagaacaattataacaatataccgtaataaaagttatgtgaatgtggtctctttctctcaaaatatcttattgtactgtactcacctattttcggaccgcggttgaccatgggtaactgaaactrcggaaagtgaaaccgcggataaggrgggactactg

SEQ ID NO: 165 - DNA, 719 bp, Homo sapiens
  repeat_region (1)..(719): mer44b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagtagtccctccttatccatgggggatatgttccaagacccccagtggatgcctgaaactrtggatagtacygaacyctatatatactatgttttttccyatacatacttatgataaagtttaatttataaattaggcacagtaagagattaacaatantaactaataataaaatagaacaattataacaatatactgtaataaaagttatgtgaatgtggtctctctctcaaaatatcttattgtactgtactcacccttnttcttcttgtgatgatgtgagatgataaaatgcctatgtgatgagatgaagtgaggtgaatgatgtaggcattgtgatgtagcgttaggctactattgaccttctgatgtctgatgatatgtcagaaggaggatcatctgcttcaggtgatcctggatcattgagccatgacaatgtcgatggttggatgtcaggagcagacaatgtcgatgactaatgggtggrtagcatatacagcntggatacgctggacaaagggatgattcacgtcccaggtrggatggagcaggacagtgtgagatttcasccatcatgctactcagaacaatacacaatttaaaacttatgaattgtttatttctggaattttccatttaatattttcagaccacagttgacyatgggtaactgaaaccacagaaagtnaaaccayrgataagggagaactactgtaca

SEQ ID NO: 166 - DNA, 728 bp, Homo sapiens
  repeat-region (1)..(728): mer44c
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagtagtccccccttatccacgggggatacgttccaagacccccagtggatgcctgaaaccacggatagtaccgaaccctattgctatcagtcttttggaacatgtttctgttcatgtcttctgcccacaaatttaatgcctcttccacctcaactaaacacgtatcatgcactccggccatcacttttgcagtttgaggtatgacatcaaaactagcatgaatttatttttccttcttcacaattccaaagatggaagattctttcttaccgtagatcttagcaacctcagcatacgattatttttcytttctttttaagtcaagaactttcaccttttcgcttaaaggaagcactttacagcttctytttggcatgtccgaattgccaccaacactactcttgtgcttttgggccattattaagtaaaacgggagttacttgaacacaagcactgtgataccaagacagtcggtctgataactgagatggctactaagtgattaacaggcaggtagcgtanacggcgtggatacgctggacaaagggatgattcacatcccggatgggacggcgcgaaatttcatcacgctactcagaacggcgcgyaatttaaaacttatgaattgtttatttctgnaattttcaatttaatattttcggaccgcagttgaccacgggtaactgaaaccacagaaagtraaaccacggataaggggggactgctg

SEQ ID NO: 167 - DNA, 178 bp, Homo sapiens
  repeat_region (1)..(178): mer45
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggaccggctacataatttgcgggrcccagtgcaaaatgaaaatgcggggccccttgttcaaaaattattaagaatttcaagacggcgacagcagagcattaaaccaagcacggggcccttctragcgcggggccctgtgtgactgcacaggtcgcacgcccatgaagccggccctg

SEQ ID NO: 168 - DNA, 1037 bp, Homo sapiens
  repeat_region (1)..(1037): mer45b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggaccggctacataatttgcggggcccagtgcaaaatgaaaatgcggggtcccttgttcaaaaagcaggaaaaagtgccattaaaggtactaaaatataaagctttttcctttcttccgtagtctctctctcgacttgtcatggtgtttttatatttgctatttaatgtcattctaagtaagaaaaattaaaattttaaattattagcatgaattttaccattcatctttatattgtgcaatgccagttttaaatgcaaatataagagcatttaactcgtatgcggaatcaccgaaattacacaatttgtattttatagctcgtacatgcgtatgtatttcgttcttaccagaacagtggaaacgctgcacaaaactaactcaactgtttttatttcacttcttgatacgcgcacattctaccaacactctctacctttggcttactgatgagtaaggaaggactgaaaggaaaaggaactataggttgsccnatctttccctttccttctatgtcatcattttcagcgtaagtggttggctaatacagagaagtaacacgagtaagaaaggatatgacagggttccttggtcgttcgtgtttcttagaatgccattgccttctttctgtgttcgaagcaagttctagtttgaatggaaagcgtggcctctcggggctgtcagtgccccgcttactcagtcgtrgatgtaacacgcttaccttgtacttgctttgagtctcgctgaactcccacgcattgtgggyccaccggaattctgtgctcatggggcaycgcgaatgctatatgcaaatggggcggcaaggaacggcggacacacatattgcgcgtatctcctctgctcacacacatgctccattgtcccatcagacttcacttacaaaacacaagttcaaagataaaattattaagaatttcaagatggcgacagcagagcattaaaccaagcgcggggcccttctgagcgcggggccctgtgtgactgcacaggtcgcacgcccatgaagccggccctg

SEQ ID NO: 169 - DNA, 953 bp, Homo sapiens
  repeat_region (1)..(953): mer45c
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggaccggctacataatttgcggggcccagtgcaaaatgaaaatgcggggccccttgttcaaaaagcaggaaaaagtgccattaaagrtactaaaatataaagctttttctttcttccgtagtctctctctcgacctgtcatggtatttttaaatttgctatttaatgttcatgctccttcaggcacggggatattcactgggtcagtgcagaccctcacaggtgcccaggrggcctcaccccacgatttggcacgcscacacggcccaccagctgttaggttccccctcctgccagccactgggccgacatgccgtggcctnccgggagcggggaagtcgagccaggcatctctccttcccacgggcctactgccccagcccaangcggatgggtgattcccaagggactgcaactttcatgccggaatgtggtmggtgcctggatgagaggtggacgagaggctcgcccccgccaagtcacccgccaaatgtgctgtggcgactgccagttcagggcaggacagctgtcgccaagccccatcccgagataccacggggcatgcgcccaaccctgacccttcttgcacccgcgcccgggccctggttcctggcggaggcarggggcggcagtggtcgttgggcaagwctgtggagggagaaggcagggcaggtctggggcaccaggagstaggggagcgggcggccgagaacccgccccggggaggcggggaggcagcgggagrcgggactgcskgtgagcccaggctccaagcccccagcacatgctccattgtcccatcagacttcacttacaaaacacaaattcaaagataaaattattaagaatttcaagacagcgaccgcagagcattaaaccccaagcgcggggcccttctgagcgcggggccctgtgtgactgcacaggtcgcacgcccatgaagccggccctg

SEQ ID NO: 170 - DNA, 784 bp, Homo sapiens
  repeat_region (1)..(784): mer45r
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggaccggctacataatttgtgrgacccagtgcaaaatgnaaatgtaggancccttttcaaaaagcaaaaaaaaaatgccttaaagataataaaatataaaattttttttttaaaatattttaacttataaaatgtaatagggataatagtgatacataaataaattataacaacataaacttataaattgcaaaaaaattattttggtgtcataattttatataatataataaataataatactttattaatgtgatatcttgattgatccataaaatttttttggctcacttttctgcaaattcatttattaggttattaaaatttaaatacttttagcaacttcattttcaattgatataattgaaagcaacatcaatcactcttggcaaatgcaagattacaaataattttttataatttttaattttgagaaggatctttctgctgatgcaactgttactggagctgttaaragtattttatatgctgtgacaacattaggatacatttatgataaattattttaaaatataaattttattacatytatagatgatgattcttgtagaacaatttttctaaaaagatttaactcttcatacaaatcagttttatataagtctgaatttaatttaaattntaaatnttattgtaaatttatacaatgatattttaatgtanttcctctgattttctgtaacttgtggaggnttataagctgaaagtggcttcatgatttntatataattcaaaatncctatttatgcattctatcactg

SEQ ID NO: 171 - DNA, 398 bp, Homo sapiens
  repeat_region (1)..(398): mer48
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgwaagattctccccrgggcctgaaagcttraggggatgartaacccctcccttcctcaggcccagtcccaaggcgcaaggtcacttgtgccagcagtgtgcgccagcaagatagcagaagcaggaagagagccggccggaagacacgtacccccgaagatcgagaaagaggccatccgggtacaacgtagcagttacgtcagactgggacacttcctgtttacaggagactataaaaccyytgccccgtcctcacttggggctgacgccattttaggcctcagcccgcctgcactcaggcagcacccaggcgctcattaaaacagcgtgttgctccacacctcctcgtgttgttgtggacgcgctctcggggttsgaaccgayacaagarccttaca

SEQ ID NO: 172 - DNA, 923 bp, Homo sapiens
  repeat_region (1)..(923): mer49
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaaactaaaaataaaatcttaagccccccgccgactgaacggaccccctcttggccaaggggaccccagagaaaccttaaaaactgagttcccggccatgacgggatgggaggtcagacacgcctcattataccccctcccttttgtggtttagacacaacaactgaccagcattaatgttaaaatagagatcataagactgacagaacggactctttgtggcaataagataccaaattataaacaggacctaaggccatgccaggcaagggttaagtcacgcacccctacacttaaagaataaactatgttctaactgccacaaggtttttctttttctctaacagctaaacaagcactggcctcgagataagcaatattaaaacaattgcagctcatccascaccagacgctgactaactgaccccctgttccaccagccataactacagctttgattggacaagagactgatttcagtaactttctcctgataagagaccaccggccatggactggttctggccagtttacagaggctgtgcacttgcacgccttcgtgtcctgaaaasaccttttgacgtatagggcctaattgtaatacatttaaatgttaagtctccaccccaaagtgaacatgggtcgtatgttacatgcatgtttgttcaatacgcatgcgtcaggaccaccttcatgaatattcatagctcctcctgtaacctgttgaatatgtatgcttagccaacccgttcagcataaagctcctgccccaacccctcctccttcgaagtgcctgtctctggtcttggccagaggctacgcttcccagcctgcgggatggccaccttgcaggctgtaaccctttataagaaataaagtctcctttccaaatttatagatctcgtgatttttcagttgaca

SEQ ID NO: 173 - DNA, 660 bp, Homo sapiens
  repeat_region (1)..(660): mer4a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgaaaggaaaataaatctcgggrccccmaaatcactaagccaaagggaaaagtcaagctgggaactgcgtyaggcaaacctgcctcccattttattcctaaataagatagctacaaagataaaaggctacatacctctctcacaatttycyacaaggaaattccttgcggacctcaagatctttaccctaaaacagttctgytgamyttcaccttggcawtgyaaatggrtacaggacaaaggtacagaactgaaagtcatccctctgctcacctgagacaaatgcatatctgattgcttcctctgccctattgtttatgtaaaaatgcagattcactgagccagactmaattgtgtattcagtgaaargctgatcarrgactcaaaagaatgmagccwtttgtctcttatctacctatgacctggaagcccctrcttcgagttgtcccgcctttccagaccgaaccaatgtacatcttacatatattgattgatgtctcatgtctccctaaaatgtataaaascaagctgtrccccgaccaccttgggcacatgtcgtcaggacctcctgaggctgtgtcacgggtgcgtccttaaccttggcaaaataaactttctaaattgaytgagacctgtctcagatacttttgggttcaca

SEQ ID NO: 174 - DNA, 611 bp, Homo sapiens
  repeat_region (1)..(611): mer4b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaaaccaaaaataaaattctaagkcccccaaccgtctgaatggacycctcctctyggccaagggcaytccaaagytaacctgraaaactagttcaggccatgatgggaagtgggggtcggacacgcctcattataccytccyycttctggaattcaggcacaactgaccagcattaacatcaacacagacnttaagtctgataagaaacagtttacaayctrttctctctgaagcctgctanctgaargcttcatctgcacgataaaacttggtctccgcaaccccttatntcataacccggacattcctttccattgatctyaantcttcaaccarttgccaatcagaaaatctttgaatctacctatgacctggaagcccccgcttcgagttgtcccgcctttccggaccgaaccaatgtacatcttacatgtatttgattgatgcctcatgtctccctaaaatgtataaaascaagctgtrccccgaccaccttgggcacatgtkgtcaggacctcctgaggctgtgtcacgggtgcgtccttaaccttggcaaaataaactttctaaattgaytgagacctgtctcagatacttttgggttcaca

SEQ ID NO: 175 - DNA, 2454 bp, Homo sapiens
  repeat_region (1)..(2454): mer4bi
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tttnncactnggaatttgggttnctanragtnaaaatantannagantaaaatgttttnnntnnagtttataangayatgaggatgtgktttttgttgaaaaaaatgtatttttgtctnagntagaagttatttaaaagttgtttcaaaataaagggaaaaaattatataaataaaaataaatgrataaagagaaaaataaaaaggtgggaaatgagaaacctttgactcctgggtggccahgtggtcacccatagtatagagctgcagctgdgctgtgttcagttactaaaggtaaaagttaccagtgaaatttagagatggatcatactcccagggagttggttcactggatgcataaggaaatgcaaactaataagncaaaaagcaaatatgcaatctcttggctattgttatctntaatagctaaaaaaaaaataaaagagtgctgggttgggtcttgatgctggaccaagctcagatgtvggtctgtctnagctcaggccactagcctcaaagctacccacaaaaagaaaaattaagccaggacaacaaaaggtacctctgagacctgtggttaccaagaagatagtcaatrtgggggaagggcaaaaccaagtaactattaaaaccagagggtataatgtaaaggaattgttccattttgtagattggtatcatcagcttcctgaaaaacctttactaaaatggattgtgagaataactaatttarggacagtatctttrrttttaaatgctgcagaatrgaagagcatgtttgggttgatgcaggaccctacagctcactattgaacaatcactgatgrgtatatgtgatccaaacacacaggaggttattcctgagagaacagccagcctagtggactggataaaagccactgtaaggtctgtttaccctgagaaggggactgcccaactctccctataaaatgccaagtgagagcaccccagatgaagcagctgatatgcttcatatgcaagccatgtgggactggctttatgatgaccgggatattcacccactgaatatgcctattacccaggtcatggtaaatgctggggttaagggggccccttttacatgggcaccccatgtaacattactcctgcagaatcaaacaactgtttaagaagccttatcaaatttgctgtccctcatgggtcttacagatgcttaataaaacattagawtaattaacaacaaaagaaaatggaaaaggaaaagggagtcaaaggactcaccccagaagsgtggtggaaatctttaaatggttattaagaaatggaataaattaaaattgatggggttaaaacaaaggtctttacaacactatcaaaggttgggtggaccaaagggagcccctgctggtcccccaacattaaagggccccaaactagttttctgtatttrctccagattggagaaatttaaaaaaaatcanaaggcaaagattataatgagaaagctgacattgcctggrgcaatgctgaggcaaatyaagataaagattgacaaaagggcctgagtcccttggctcaacyccctgctgggaacccaaatcctttttcaccagaaaaggtaaaatggtctgggagtagaraagaaaggttcctgggaccagaacataaaaatgtaaaggttgatataatgaaadatatacmnttntnaaagsttgaattataaaatttgaaatgtttaaacakyggctttatgtaaagtagttgtaactcctttacctaaatgtcttatgaaaatggntantgtatctaactgggggatgtttcccctatctagtactataaaacagaaggcatgtaaatctgccctttaagaaatgttaattggacatgctaaatgggaacyagtaagattgcctaagcccacagaatatagggtagaagctggagtgctagtmgggacaaatcctccacttcatagccctttgtggagcatttacyggggcttatggcaaaagcctgtgagtacttcccaatgacaacgactgagactttggactagagaatttccacttgaggggcatttactgccttgctatgggatgttaactgaagctacccctatgctaatgaaaataatggtgcccaaaagagttccatgataaaataaaaatggtttatataggatcttgctacctgggaatgyaaggaggagatactcatgagcagagagcctcttttcccctaggactaactctaactgtgtgaggagctgctagattctacagtgcctaataaacagctctcatytgacaagagctgcttggtttgtgaatggcagttccaaggtaaacaaacaacatcttgtttggaaggctgctgctctggttaaagaagagtcaagaaaatctttttcttttaagttatttatagtttagagcaattgggtaaagtatgtttttgtaagcaaatttac

SEQ ID NO: 176 - DNA, 465 bp, Homo sapiens
  repeat_region (1)..(465): mer4c
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgaaaggaaaataaaaacttgggaccccaattcactatgccaaaaggaaaaaattaagctgaaagctgagtcatgcaagaaactgcctttccttttgttcctaagcagatagctacagataaaaggttaaatatctccacaggtagctactctatgttcaccttatcttatgtaaagtgccgatttactgagcacgagacgaatacataattgactattcccctacctgctccttttctcttgcaacatgtggattcagtaatgtgaccataccctccctctttcccctccagcccgcttttcccctttaaatattgaagccctcaaaatcatctttggagaaaggcacagaccacagatgtttctgtgatttcgtgtttctttctcccgggcatgtccttaaccttggcaaaataaacttctaaattgattgagacctgtctcagatactttttggtttaca

SEQ ID NO: 177 - DNA, 1017 bp, Homo sapiens
  repeat_region (1)..(1017): mer4d
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaaaccaaaaataaaatcctaagccccccaaccgactgaacggatccctctcttggccaaggggaccccaragaaacctgaaaaactaattcaggccataacgggaagtggggtcagacacgcctcattatagcctcctccctttggagttcaggcacaactgaccagcattaacattaaaacagagatcataagactgacaaaacagactntttgtagcaataagataccacgaggacgaagytctkatttttttatcttgcccaaattcctatgtaaggggtctagggagtcgcgccttacaaaccatgaattctcattagatgggttttattaaaccctgtatatcgtgacttaatttccaacctgactctggtatagcatcacatgacagatagcagaccctgaaggaaatcaaaatattttaccccaaaatatatttctttgacatattttgaaatggccctgcgaagctgtctcttgtggggaaaatctgcattctgtagagaatctctttccctttctaggtctttttccctgatccaggggagaataactgagagtctggcaccttttaaggtctgataagagaaawttaccatctattctctctgaagcctgctacctggaggcttcatctrcatgataaaanccttggcctccacaactccccttatcttcactcgattgatttcaaytctttagacagagcttaactctttcaaccaattgccaaycagaaaatctttgaatccacctatgacctggaagcccccgcttcgagttgtcccgcctttcckgrgcgaaccaatgtacaccttacatgtattgatttatgtctttgcctataagttccgtctccctaaaatgtataaaaccaagctgtancccgaccaccttggrcacatgttctcaggacctcctgaggctgtcacgggccatggtccttcactttggcaaaataagcctctatttaaattgattaaaatctgtctcggatattttttgctttaca

SEQ ID NO: 178 - DNA, 780 bp, Homo sapiens
  repeat_region (1)..(780): mer4e
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaggactaagctctgatttttttttttttntttttatcttgcccaaattcctatctaaggggtctggggagtcatgccctacaaaccataaattctcatcagatgggttttatttaaccctatatatcgtgacttactttccaatctgactctggcataacattacgagacaaggaagaaaatcaaaatattttaccccaaaacatgtttctttgccatatcttgaaatggccctgcaaagctgtcctttgtgggggaaaatctacatctgtaaagaatctctattaacatagctagatctttttcttccaggccttcccaatcctgaagagattaactaagagtctagcaccttttaaaggtctgaataggaaacatttgtcatctattstctctaagggcngccactatgagacttcaaaagaaccttggtctccacaatcttttatcttaacctgaacatttcctttctattgatcccaggtctttagacaaactcaaccaattgtcaaccagaaaatgtttaaatttacctatagcctggaagcccccactttgagttgtcccgcctttctgraccaaaccaatgtatttcttaaatgtatttgattgatgtctcatgcctccctaaaatgtataaaaccaagctgtaccccgaccaccttgggcacatgttctcaggacctcctgagggctgtgtcacgggccatggtcactcatatttggctcagaataaatctcttcaaatattttacagagtttgactcttttcgtcaaca

SEQ ID NO: 179 - DNA, 6388 bp, Homo sapiens
  repeat_region (1)..(6388): mer4i
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tggtaaccatggaagggattctgagtggagatgcccctgacctttgacaaatctcctatcggtgcttggtaccagcatgagctaactttatggcycaagctcaarwtrtctttatkgctcaaaccaataggacaatttgctgaggtctgrgagcatctccctccagagaatccctgatctcccaaaatttggtcgagatctaargtttattttgctgtacaactcctctttttttggagttttacttgcttccaacacaaggaaggcgagtttttcctgcttccatgatgatggaaggcaggtaactcctttmtggagtttsagctcgcttccaacagggaagrtgagttttttttcctgcttctaggatggtagagagcagtcttcagcctgagacccattcctaggtaagtaactgaattggggtttgtcttggaaattctccttcttggctaaaagttaagattaacaatcttggaaattctccttaargactaaaagttaagattaacaaccagctggtcttaatttctccttaccattagagcgctcagtaatcatataagttgtgcgatcatttgttttgcttaactgcttytgtttttgttgtttttgtttgtttctgtttttgttgttgtttcwgtctttttcctattgggtttgaccaactctatccgacttgatcagtgtggtggggggagaaaaacggccagcaaaaggaaaaaattgancttgtttactttgactactaaatctgaaggagaattccaaattatggggaacaaggcctctgaagtggctaaattcccacaaaaaaaaaaaaaaamaaaaaaaaaacaaggcyagctttttgctagccaggccaaactgaaagagcaatggctgtcaccycacgctgcagttcwatagctaaggtyctgcnttttttttttttttcaccgtgacagcctgggtttggttcytaaatcaagccctttctggtttgatasttggtacttctgaaatagcagcwgtttgtcctagctaaaatatggtaatgagatttkaaaggatttttttaaaggagctcaatggttaaaagtcagcttaattaaaaggctaacatccaagatgtatgtgtgtatgtgtgcgtgtgtatgtgtgcatgtgtgcgtgtttgtatttaaaaggccttcatgtttttgtttcgtcgtttgtttttctctcctaagaccttgtctttttttgagcaaagtttttttcttctcagttgactgaattctgttttcttcatttacttttcttccaccctgttcctccttccctttgccatcttykgyaccaagtgaarrgayctagaraaggcttctaatracttgagaccccttaaagaacwcagaaaaaggtgccacwcacccctttttgaggrtaaacttctgtttttccttatgggacctcaaaagtagtaaahagacagattcctctcaggtctaaagctctgctytcttttgyattgcgttacctgattttttgactaaaatagttattgcaacagaggctactcttgggtttttaaggaagagtgtagtgtagacacttagaaatgtctttgtttaaaaakttaagtrcactgtaaaagcatcatrtggyttagyctcatrataattctccctttttrgagacccagcattcagtgtgggctctgcccagagctcagtgrtccagttaaaaataggtagtctctatytaaataaaattggtctccttataaaatcctatgatagatttctataattttatgtttratttggcatcaatytttaatcttcctctagcaccaccagactttttctctctgtactttaagatgtaaattttgctatytgatttttcacctaagagttgtttcctttaatatgcaaatttagggctatttagctgacaactgcctagggtaatgaaacaggttatcaagaatttgaaagtctaagataggaaaaaaaggrggtcttataaatctataagatgtacttctatcagcatgcctaatacgtctatgtatttatgtgttgtgtacacaatgtttcactactaaaaatatataaaagagctctaattaattggcttaaagaaaaataaaagtgcttaaatcaaatactttatcaggaaaaaagaaaagactagtcaaatgctttttcaagttyatgaaatgctttttcaagtttatgtaacttaagtaaaatctttaataaataagctagctttaaaattattggtaaagtaatattagaaatgtcttaagaattgccagcatacatttttgtttgcattatattaatcaagcartttcatacttatccctgccaaatactataaaggtgtcaaaatttggcataggggttayaaaactataaacccagcccaaaacagaatgatctttgcttgtgtaatttttaataaataagacattgatattggtttaatgaaaayagctrcatcttgaatttagtaagattaccataacttctaaccttgtggctttaggcgrtyntttaaatgatgactatcgcagttttcataaataatctaggtaaacaattaataaaataattaggtaaatgtaatgggataaatacttgtagacaaacttgtcataatttagaatataaagttatattaaattaaataatagatawttwattatttgrgtattttccaataaaaatatattgtaggaaaacattcttkcttaaaaaaaagtgtgtcctttttaaaaaaatggtgaataagttttgtctaattcaaagcttatttaaaggttatrtataaaacaaggtaaaaggaaccaggaaataaaaaaaatgtaaagaaagttataaaaataaagaggtattttttgnargtaaaaaagctgaaaragaaataattttatatgagaaagaatcttatatggtaaatttatgagaaagaatcttgtatggtaaatttttgtcctaaaataaaatgactggtttttaagaaagaggwtgtttaggacaaatcagaaagtccaagcatgttatwaatggtctgtgtaagtcataataaggtttgcataaagagaaattaaaaaawtttatatgattaagttggctataattaaaagraaattatttataatagtctttctagagattgakgtttgatattaaaaatacactaatacactaaaaattkgttagaaaaacaaaattttcttaaagtattgatttaytcataaaattacaagagattttaattttaatccaaaaattcaacttttattgcatctcactgttttcaagctttttctcctctttgagaaggcctgagataataactctctccttcaacttttttgtcagctcctgtaattttttcctchggttctaactgytgttgtggcctgatgctaaaaatgttttatyttaaaggtctaaaagmaatgttttcttccaatataacattctgtactckkcttttcttgatgtgtctgaattgttccatgaaaccagaaaacttcactcataaccctggayacactcttccttgtctaattaattcaagtactattttcatcagtttgacttcaggttatctaaagggcttcccataaggagaagcaatcacactgcagaaggtttttcttttsctttttggtaactggcctaagaaaaagattttatgttttatcaagataatttttgtgttattattattaagtttttgatttgcttaggaaaactgagattaaaattttttaaattaaggttattacatccatgtatctttctgtattgcttttaaagtccttgtgacattgagttacagggctttaactcctgggtctaaaaaggacaccaagtcctgctaaatcttaaacactgacagcaattaaagccycatcttcaggcccgtagaagatgccaatcaaaataaactgcattcctgagacacaggaaattaaagctattcaactcctcaaggcccagggactatccagaagaggtgggcacgtgagattgtaagggccaattttgaaagataaaataagttcaragtttctctataaattaatcattaaaagtttctctataaattaatcattrawatcaaaggcacactgatgcaagaccagcatatgggcccctgtgtcagattaacaaggttttcttgaagcattaacckactccttaataaaggttgtaaaggttataaaaggcttatgraaattatatcttatggtcaagattaaaattttatagattgtttataaaattttgaaaaacaaatttaattggcttcatgctgtttttattagggcttattgtttggaaaattaagtctcctctctcaaagaatgaaggtttttgccttttttgaaatccttgagttatcactttggttaaatgaatgacttattttacaatgacctgtgattctattttgtgatatcaagtgttttaaacctttgatatttgacaaactttccaaaatcaaattataaattatgtctttctgacctaattaatcctttaagatattaggttccttaaagtccaaaaatgacataatttggcttatttggtacaaaaattatayaggaagcattgtcaaatatgaaaaatgtttaancytctttgggttrtatttgtataaatatgttattggtatatgttccaaaattatatgaaactcctataattctgatatrtcttagtgtatattatcartaataattataattattatgttaaattattgtatgccacagargtaaccaaatttcctcgtcaattgtgtctttaactatggctgttctaagacttttgtcatccacggacaattgttttattttgrtcctytttaaaaggtagtttataatcagctatagractctaacaagcgctcttaaatrcaggtttctgataactttggagattgtgacatcggaatagaggaaaaactttcaggactcatggararctaatgtgttcatgaggattgctaacccaacatcgagcaagcagaacaggaattaactgcatggactgaaccaatagaagabtgaaadaatctttttgactttttgcttaaaacgttgctgatcctttgttttgtttttcagagtcaagaaaacttttcttttgagctatttacagcttttaacaattgagtatagtatactcctatgaacaaaatttggagcatatttgtttctctctacctgatttctccagaatttggaaactatttgtgagtattcttaacttatggcaatacagttatttgcataagtgcaataagaatctgttttcatttgtaacaggacacaattggagaaactggttattttaccaaggctttgactggaatggtgtactttcctttaaggaatcaaacttgacttatggagccaataaaagcccttggaaaaactggcctcataccttgtbtacgcagtccctgtacaaggtttctgacctgtggtaagtaaagaatgtcactttctgacaggcccaggagccccargtttatcttggaacctcaagaggagaggaaattcacccaattcataggtatttgawggcgcaaatccatggctgggctcggctttaaaaaagtcttatctgagattccttctatggaaaaaagttccakcaaagccaatttaaaaagagcctatataamaaatmattattcttgctgcactttatgcaaataatcaggccaagtataataagastaaaacttattttrhaaacaaattggtcctaccatgatttgtctttagtaaaaatgggaaactggagagagaaaaattatgtttcaaaaactatagtatacctgttattagattctagttgtttttcaatttttattattttctacagtttggactgaattctaaattttttcctggctacaagtctccaaaataatgttttcaatactttttctttttttccttccwtttttcccatttttcctaatttaaaatcactraaaactaaagctgtgcttktcttaaagccctgcaaactgaarctagacaacttaaacttcagaagaaaataatagcaacctatttacatacataagccactttcatacctgcctactgatgtatngacttcagagtaatgtgrcctrtrtcaattttccaggattgttcttttgtttgttgttgtttttctcccttcctcctcctattttstcttcataggacatgagacttcacaacctgctaaaaatragctttcctaawawctcgggacctacccgtctaggaataaactatcctagccacgagagatcagacgaaacctgagaccagagactcattttcttctaaaatgctttctccaaaagattttagaaaagaagggaa

SEQ ID NO: 180 - DNA, 734 bp, Homo sapiens
  repeat_region (1)..(734): mer50
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttagagtaggtagctaggcagrcatgagcagggcaggagagggcnccccccacacacaccacgaatgtcgggtgaccatcaggtgatggtcaggcggttgttaaactgtctctctaaaataataattggtcacagccagcgccagggaaargcagtctcctaatagatagaaaacacctgaarctggtgatcagcagcttcccgataagatctcaggagttgggcgagtgagctcaagcatgcgcactaagaggcaaaatgrcggagtttaaccggcatatgaccttcctctaggaacactccaatggtaagggaaraatgcctcaartgagcatgtgcacaactccagtaaacacactgtgcatgcggcccytcccaagtgctggcaggccactgcgcacgcggacagcccaccccaaggaaaaatcaagggaggagraacgcaaaccccggaagcatgccgatgtataaaaccccaagtcaaaggtcaaaccgcgcacttggtctctcaagtcgcccgcttggccctcttccaagtgtacttcgcttcctttcgttcctgctctaaaactttttaataaacttycactcctgctctaaaacttgcctcggtctctttttctgccttatgcccctcagtcgaattctttcttctgaggaggcaagaattgaggttgctgcagacctgtacggattcgccgctggtaactcagataccttccaccggtaaca

SEQ ID NO: 181 - DNA, 1405 bp, Homo sapiens
  repeat_region (1)..(1405): mer50i
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tactttggtgccacgtgacttggatacgttccctagtggtaagagacctctatgcctcaccttctttggctggaggcgttcaacccccgtacgcggttttcttctcccctttcactctcctgcttactaaccaacccccagaacgattcctctcagccacagtggctctgctccccctggctgatctctcagctcaccctgacgggtggctcgcaggggtgggaaggaccttggagtccacaccgagtagacctgagacactaatggccctcctggacaggaggctcatgagagtggtagggctaaagcctaagaccgtgcaatgtctggggtttcctctgctttttcaactaaaattggctctttcccaaaaacccacaccgcctattctcctgttttctctgtgtgtgttctgaaatggccttgcgcacccgccggactgtccacctcgggggcaagtctgccttttctctgctttcactttgcatgccacgcgacttccttctctgccttaaacacacactccctgtttgttatttgtgcacccgcggctcttgctgcatttgcatggcagcaaagacacgggctcccttgtggatattccctgagatttatacttgtttttaccctaccagctcagatgacctccaacccttcctctgtctgttggctcattgccaggacagacactaatcggaaccccggctctgccagcttcttatgacttaccatatacttttcattcctgttatgccccagggccaagttttccggtggcttttgaagcagtttgtccgcctgcataggacctcactctgtggccctttaaggacctcacctacttgctttttttgagttagcactcctttgggaggagggaaaattcttcctttgccatttgcgagctcttatcccaagccccaagtcctccagaggttcctcctttatgtcaagagggcaaataaacgttgccctctcgaatccaagggctgctgtttttgcgagcatatgaaggctttccatgagtattcctcttgcttcctcccacttcctcctgtagcagagggattgtcctgtctgcttaagcatttgttctgcatgttaccccaggaggacaaggaaccccaaatacaaaattttctccattcctctaatcacttccatgcccttctcaatatgcatcaagaccttcaaggtcatattcgaagggagggaagtccagccccttgcggcagttagctgaaaaacaggcttctcatctacttaaagaacatgggaaatggaatatgagaaaaaaagagataatcattttgttgctagaatgctccaagtgagagtcactataaggtcatggagacaaggatataggctggcccaaggccgcaggcacaagagacaaagtacc

SEQ ID NO: 182 - DNA, 617 bp, Homo sapiens
  repeat_region (1)..(617): mer51a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaggcaggaaaatagggtctggaggcagggaacataaggccgattcacactgacttcctagaactnaatcaaanggaaaaccccaactttccacgtccamgtaacmaaaggaccagaggctactccctttrcannnnnnngatgaaaaattgaaagtacctctgattggtcccttcccgcaaccaatcaggctggtcgttggcccaagtcttcatttgcataggagtataactttgtaacttcacttcagcctctgattgatwrctttccgcaaccaatcagacgtttgcatagggtgtaactttgtaaytcgcttcagcctctgattggtcccctcccacaaccaatcagactgatcgtgggccacctcttcatttacatagggcgtaccccaagtaaccaatgggaaacctctagagggtatttaaactccagaaaattctgtaaccggggctcttgagccgcttgctcgagcccgctcccaccctgtggagtgtactttcgttttcaataaatctctgcttttgttgcttcattctttccttgctttgtttgtgcgttttgtccaattctttgttcaagacgccaagaacctggacaccctccaccggtaaca

SEQ ID NO: 183 - DNA, 371 bp, Homo sapiens
  repeat_region (1)..(371): mer51b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaggcaggaaaatagggtctggaggcagggaacataaggccgattcacacttcagctatgacaggaaatatcctctccatagggcataggccgagtaaatgactttgtaactttacttcgtcctcttcatttacatagggcgtaccccaagtaaccaatggaatcctctagagggtatttaaactcccaaaaattctgtaatggggctcttgagcccctatgctcgggcccgctcccaccctgtggagtgtactttcgttttcaataaatctctgcttttgttgcttcattctttccttgctttgtttgtgcgttttgtccaattctttgttcaagacgccaagaacctggacaccctccaccggtaaca

SEQ ID NO: 184 - DNA, 7816 bp, Homo sapiens
  repeat_region (1)..(7816): mer51i
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tattttggcgagccagccaggaggaagaggtaagcccaaagtttgggattyatttttctccytttcctttctgctccatacaggggamtctctctctctcttttcctttccaacttgggacccttggtgggcagcgcctaaacatggaagcaactgcaggtttctggccgtggccagtgaaactaaggrgtttccatgtggagaagcctdaccaccactgcccggttcacttaagggacctgagtctttttchtttttcttttcctctctttvtttttcagtctttcagtggctgtttcctagtagctccttggaaattgagggcaattggctggggtcactccccagtactgcctgaaggcctaggaatgaatgggaataattgccctgccccgaagggggaatgrmwcttttwtttttttatcttttccgvgtgtggtccctgatccctacatgcggcacagctcagrgcaaactcacacgtgtttcaggkgacttaaaccttcttttcttatgctaaattcttcccttatcgtactcaactggctaaggaacaaaaaggcccacccagcatccagttcctatcattacagttcatggctatymctaatggaatggsaagcacgggaaagcgtggcgttatcaaattmtaagkatgctaraagktgrggccttcatcyaggkacwawwataaagctcatagtaggctctggagggaaagcatgcaaagtggcactggtgcccacctaaggtcagagacatctgacactctaagattggacccyaaagggggaktcccttggggatcctycagaccccaacctctccaaaacggawgcccttggcagaggtcctgaggtctagtwctaagccccccttagaattttctctmgsagttgcaatactgtgtggaccccmtattgtttggaatctgaagtttrctgttgaatgggaaagtgagacggcgttstatgtrtctaggcttttgtgctgcgtttctaagcagggggcctggtgaacgtgttataccttcctttggtaccgtttggccccagtgttctttggagtctggggaagtttggcctctaaaaatcaaactgccatggaaactgctatacccgaaattttggttcacagccttcattggattatctattgggacaaagtaaaaccarcgagcttgtattgctatctcatggctarggttccaaagctattgratcttcatttrtgtgtgtatatacgtgtctagatgtgtttatttgtatgtacacytattgttatacgttgtgtctaccataattggcytacaagtaaaagagcactcataaatcaagtaaataagtcagagcaattttcaagttcacatgactataagtataactttactaaacaagcagctttataaattattgaggaaataaaaatagaaatgccttcagaattgctagcatacgttttgatctaagttttagatttgtctctgctagatattcagaaggatcatggtttggcatagaaagttataaaactataaacccagccaaaacaaaatgatcttggtttgcctgcccttttttttttttgacaaatgatagtaatttaacattagctaaatcttctgagctgttggccaaaatatctatgtacttaactttgaggctcttacttaggtttgggtgagcacctgatgttcactggctattaaaaatgtggttaacaaggaaataactcactttaaataatagtgtctaatatctcagtttacagaagtaatctagataaactgtttaaaartraaaatttaagtacatgtraatgggataaatgttttaggtraactttttgtgtaaattaaaatcttaaarttatktttgatgctcattkaatatctgggtcatttccaattaagaaagggttgtratatggggaaatatgtttctaaatactgtggaattrttcttatctataaatgtccatatctartagytcaggatttcttgctttttaggrtttcactaaagttttaggttactaaggataaaattctagttaacacataattttgtatacaaaacgtaccagaaagggttrtgttattartgrgaaaaagaataattttrtctaattcagaagttatmtaaaagttagttcmarttacagayttsaaaaggttatttatgaaayaatgtactamgkaayyaktargtaggggagaaaratgtggaaaaagtttarataataaaatattctttaaaacctgataragaattggagacatttgrctaattaacattttcatagttaaagctgttagtcttgaytdataaaataagaagtattgtaaagaaacgcatcrgcagtttggcaattcttttttttaaatacagttaagcatgaagctggatttagtgtrgagccaaatttcayatacatamttgcattgcttcmcmctatgtttactgttttgcgtggatagtgctggcactggagtacttattggtcatgtgcctaragtgaatttcttgrttgyacaggatgtatrrtgatattggtrgacttgaggatayttaattgtgtatcaggaataaaatattcattatgtgagtttttttgggggrccctaggtaacactrtagtctccarggtarattgagtaggaamatttagggttggtktcctgtttayttgtytttgcttcyarttttcattcgtttgctgtttatttctcctctggctttscttgtgtgtgatcgtatatacataaaacyattgatttttttgwtwygttttttagttyctagtggaaggcttttatttggttctgtggatagttattttgtttcctatgctatatcattyctagcaagtcatcatttgttccrtttatctggaattcctargctacctttgttaggcccgcaggaattratggagcacacmarcttttctatcctattataaactaactttttggawtttaggcttcctgatactttaagggtgttgagtrtactytcwtaaatagaatttgagtcratatttctctttctctgcctaatttctccaaaatttgtaaactatktgtgactattcttaattcawkgcaatgtgwttgtttgcatacacagtcragcagggytgctagggcygctcagggagagagaacccagaaacctggcatgcwggcaaaagggtaagaatttcttaccaktcagwctctggcctctctctctctttctttctctctgtgcaaactggttaaatawawagtaaaagtcactgtttatctcctctgtaaagttttarattaatwkrwwwaagaattctgaggctggtcttaagctgtagtgaatctggtgtgctttatgtgtctttctgtattgttctgtcacaaaaaggggtacattaggataaaatgcgtgcctaggactccataggcttgctgttcaagatggcccagcaaactggacagtcatgtccttgggagcttgacctcgtaaccatgtggccatgctttctttctcttttcacaatggcagctgggtttagggttcaattcctggcttagggaatgagtcctttatcttctatctatgtatttatgtgtgttgtgtaatataaaagaactttaattaattggtcaattaataataataggagcttaaatcaaatattttgtcagaaaagtrraaagtttaatgccttttatttagttcaygtgrcttaagyaatctttgggaaataaagacagttttaaagattattggtaaaataaaaatrtcttcaaaaatgtaaaaatktggtctaaattatacagktcaratatyaggttygctaaaatgctttaaggtcataaactgcttgtttgacttttaaaaattattcaatttattttggagtattagattctaggtaagacctggagacatgtgaaattagtcatgtcacctagctatgcaaagaagtttataaagaaaagaaatcttacataagaaaggatcttatatggtaaattcttgtcctaaagtaaaataacaggttgtttaaaaggagagatgtttaggacaagtcagaaagtccaagcatattatagatggtctgtgtaaatcatgaaataatttatgaaagagaatttatgcaagaaatgttgtacagtttaaaggtgattaggcctcctaaatgcttcataamatgttactgtgactcgaatgaatawctgtwcaacttgcctgcttyacagctaggtaragcgcgtagggacasatggagtggccacrccccttccatgctctacctactgatgctggaaarggtcagaccttatctggacttctgggtgggtcctaggctccacccctagtacataattaaagaaccctaaacttatcaaggttwtcwtcaaaagtaaawgtcgycaagagytmgcattgtaacatstaatwgarcctactgaagaaacagttttacatsaaaggkatgtaaagcaagaaaagtgaaatagggtttggtgtttttggtaaaagattatawkmwwkmawrggaatgtgggtttttttgttgtgcctaaagggctaaaagattgttttaagttagaataaagctaaaggtttgaacaggttgtggaaggtttgcaaacaattaatcttgtaaaaaattatgtgtgtgaacatattgactaaatttaaagggttattttctggtttgtctgtaaattgaacattgaaataaaaacacaaacatggttttcttaaagcactgatctgctctttactaaaaatttatagagggttataaaagatttatgagattctcattgtatggtcaaactgattaagatcggaaagatttgtctataaggttttattaaaaattggggttgacattaatagtacactaatgcaagggtgaaatgtggctttctctcctgaacaagattttcatgtaatattaaaagacactgaaagatttttatttgccttttgaataaactaccaacaaaaaaagaagggaaagacaagagacagattgtttggaaagctaagtcttccctctttcaatgagtgaaggtttttgtcctttaaagaggtttttttggatcaatcattttggmtaaawgaawgwcttatggtaacctggagttctakwtcatamtatcaagtgttttaagcctctaacatatttgatcwgrmttcccaaaatcaaattgcakcttcaaaattgtcttytcwgtsctcgracttctgaggatgatgmgaagggcccacgtagaatcatccraaagagaggtgacaagaatcatttgacwcgtttagttacatgggaagtattsacaaaaactttratratytagtcttcttcaggttatwgtttagtgaatgactcatatatatattttccaaaattgtatgggatttctaaaattctaagatgtctgagtatatgtcatcaatcataattawggttattatgttaratgattgtaaaccacagaaataaccaaatttccttgtcaattgtgtttttaactgtaactatttaaagttatttccacagttaattgtttaatgctgatgcagtttctgaaaacgtcacaagcacacaaaatcctagaatatggtgtcttttaggaagttgattaaaggatggaaaggactctaaaaagcactcttgaatacaggtttctgagaactttagaatcatatcatttgaactgggtaagaattcctggaactttaatgaaaagactgactgggttataatacwgctaacctaggatagaagcaaaagattaattaaataccaagaaaatactttkccagatttytatkctaamtcggcwattactgaaattgtttagatatrcaatttgactgarttcbatggtctaadtchvagtaactatgataavccatcvgttahcagtgbtattcaccthctdtgdtgaaachactggtaddcaagabhatataabdctaatgtthattaagcatggattcatgtdddatgadgdtggtcaccttgavgdbbgchadtvctthaagagtttattattatgctacagtgtattttcaccargtaaagaaagaaarctttttatgkyytgaatcttctggaaacaycagagaaakactrtccttgycatccasrcyacwayaaaacttcrggrmyttgrrctttrggttcatrrtctcacaaytgagaagggtccctcyayrctcttsaarctgtrsacccattggaacccttaaggtwaaactaaccarggwaatagtthcaamtggacgaagagttcatctttgatgtaaacatctttttccaagatcacagattaagacttctactatcatgagactcttatccttgaatattktcttttgtttatgcctctatgaacaatagaaatgaaaaagggatctgttttgtgcacttatggggtatacttttatttgtgaaggattttgcagccagccttatacatggataatcttatactctgatagataaaagatgaagacccagtgtaggtgagaaactttaatgctacatacgttgcctcataatcagtcagaaacagaagattggttcactcccattaacccaaactcatgggttaaaaagaacadtcccaggaggccttcactcttctataagagaagggcatcatttattaggtctattttccatttkgwaggatttgdaataaaagavgtaatgatdaaaaatgtatccctcacaataggttctatagcagattctactgtaaagtctatagttacacaacagactttaaattatcttgtgaaagttatgctaaagaatagaattggccaaagagaaaagtatctatgcagctgctggcabtcatggcctatggdggaaaacathaggtrarkattatagagtttcagttgtagtggattgacaacaaaaadactgtttagttaagtgagtagactgcttatctagctcattctttgatctatttgattttaggtggtttggtttatggggaccctggataaggaacatacttcaaactcttggtattatcchchtgatagtcataataatagtctccctggtgcattgtattctctcaaaggttttacatgcttgcatgcagccatctctagaatgtcaaatggtctctcttcaagtggaatgacaaaagctgaatgaaatatgtgaccacaaggacactgtaacctatgaatggcatgctgagaccagaaacccaaaatgatggtaactgagagtggtactaaggctctaagttttgdtcatactcttacctaagtgagaacctgaccaaaaggggggaatttttaaaaacaaaattgtggtaggccattgttttggactgagctcatgcattagacctcatcagatcaaaccaaaaccaaaatggagttgcttgggctaagactttaaggcaatacatatggatcctagaavagaavaggttttgttttttctcctgtaaatctctataacaaacattcctgagagcataagtatchacctcctgaagttcccattaaatcttttaaccaaattcatttcctctctcctagagaccatcaagcttcagatgatcatgtgacaaaggttccagtcagttccaggtgaagacaccacccctggtcattaaggagctaccctgtctccattagahagagcagggtaagagttctgtgatccacaatgggtagggactacacchbgagccagcatgaagcagttacagaagaaagaccgthagtccctctgcctcccataaagatttatggggatcacatctcwtyggggggaa

SEQ ID NO: 185 - DNA, 1755 bp, Homo sapiens
  repeat_region (1)..(1755): mer52a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgatggcagcggcggcccgtctggagtggccgctgccatgatgccggctgcagcgggggaggcgcggccggggctgcgcgctccatggagccagcgggagccgggaacaggcgggagccccgcccccttccgagttggggcgggagctccccgggtgcagctgcagccgcccaaacgcagacccaggcctccctgtgctcttgggggccgggagcaggcaggagccccaccctcccgggcacagctgcagccgcccagccgcggctscggacccaggcatcyctgcgctctcgggggcctgggaaggcccccctgcccccacaggcttggaagtgcctgctcccactgcagctggcctctccccgctcccggcgcccgctccgcaggctcagaagtgcctgctcccgctgcctggcctctccctgctccyggcgcccgctccgatttcggagcaaagttgyggccgagcccgggcgctgtcgcaacccggccgggtgtgtgcacgctcggggcagcgctgacacgccagccccctgccgcctcggccccctccggactttgggcgccgacgagcatgggagggaggccgagggggggctgagggcagctcggcgckggcctgcaggcgcccctcggcacgaacagcctgggtgccatgaacggcagcaggaggcagacaggctcctgggcagaaaggggcgggtccccggtgaaaccccaccttcaagccagggacggcctgaagcctgggggccgggctgccagttccgggtggagtccgcggmccggagtgagaacttrtggtgctttttctgggcccacccatggccgcccatggaccaatcagcacgcacttcctcccctctgargcccataaaaaccccggactcagccagactyagrcagaygwygggacgaccagctgcagagaggagctacccactccggggtctcctctctgctgagagctgcasagwcgwcgggatgacctgcctgcagagaggagctacccactccagggtctcctctctgctgagagctgaacactcgtcgggacgmcctgsctgcggaraggagctacccactgcgggtctcctgagagctgttctgtcgctcaataaagctcctcttcgccttgctcaccctccacttgtccgcgtacctcattcttcctggacgtgggacaagaactcgggacccaccgaatggcggggctgaaagagctgtaacacaaacagggctgaaacacgccccctgctcaccacgttgtgggcgacgagaaggagagaagagctgtggcccttcggggagcccagacctaggagctccccgagccagggctgtgacaccctctttggggctctgcggttcctggcgtctccaagcttctgggcgccaccgcgttccccggtgccmrcwgtggaagctgcttgcggtacgcctggtccagccgcagccttgcacggagccggcacctgtgccggcgcctggagctgcctgccccgccgcagccrgcgtgcctggctgtgcgcagtggccggaccccacgctcgcttgctcacacacccctcaccgctccgcgcctggctcgcccttggcaggcatgggatccaggccrgtagcgcgagcygagcgcagcctgccaggccgagtgggcggaatgagcccagcgggcccaagcaaaactcgggcaaaggcgccaccggccacagaggtttccggctggvraagcgacaccccaaggatcccgtgaca

SEQ ID NO: 186 - DNA, 1746 bp, Homo sapiens
  repeat_region (1)..(1746): mer52b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgatggcagcggcggcccgtctggagtggccgctgccatcatgccggctgcagcagggaggcgcggccggggctgcacgctccatggagccagcgggagccggggacaagcgggagccccgccccttccgagttggggcgggagctccccgggtgcagctgcagccgcccaaaccgcagctgcagacccgggcctccctgtgctcttgggggccgggagcaggcaggagccccaccctcctgggtgcagctgcagccgcccaagccgcggctgcggacccaggcatcyctgcgctctkgggggsccaggaaggcccccctgcccccacaggcttggagccgcccgctcccactgcagctggcctctccccgctcccggggcccgctccgcaggctcagaagtgcctgctcccactgcctggcttctccctgctgccggcacccgctccgatctcggagcaaagttggggccgagcccgggcgctgtcgcagcccggccgggtgtgcacacgctcggggcagcgctgacacgccagccccctgccgcctcggccccctccagactttgggcgccgacgagcatgggagggaagccragggggggctgagggcagctcggcgctggcctgcaggcgccccttggcacsaacagcctgggcgccatgaatggcagcaggaggcagacaggytcctgggcagaaaggggcgggtccccggtgaggccccaccttcaggccagggagggcctgaaggctgggggccgggctgccagtcccgcggaccrgagtgggaacttgtggtgccttttctgggcccacccatggccgcccatggaccaatcggcacgcacttcctcccctctgaggcccataaaagccctgggctcagccagagcwgagcagacgacgggacgaccagctgcagagaggagctacccactccggggtctcctctctgctgagagctgcasagwcgwcgggatgacctgcctgcagagaggagctacccactccagggtctcctctctgctgagagctgaacactcgtcgggacgmcctgsctgcggaraggagctacccactgcgggtctcctctgagctgttctatcgctcaataaagctcctcttcatcttgctcaccctccacttgtctgtgtacctcattcttcctggacgcaggacaagaactcgggacccaccgaatggcggggctaaaagagctgtaacacaaacagggctgaaacatgccccttgctcgccacgttgtgggcaaagagaaggagagaagagctgtggcccttcggggagcccagacctgggagctccccgagccagggctgtgactccctctttggggccctgcggttcctggcatctccaagcttccgggcgccaccgcgttccccrgtgccagctgtggaagctgcttgcggtgcgcctggtccagccgcagccttgcagagagccggcacctgtgccggcgcctggagctgcccgccccgcwgcagccrgcgcacctgactgtgcacagtggccggaccccacgctcgctcacacacccctcaccgctccgcgcctgactcgcccttggcaggcatgggatccaggccggtagcgtgagcygagcgcagcctgccaggccgagtgggcggaacgagcccagcgggcccaagcaaaactcgggcaaaggcgccaccggccacagaggtttccggccagaaaagcgacaccccaaggatcccatgaca

SEQ ID NO: 187 - DNA, 1278 bp, Homo sapiens
  repeat_region (1)..(1278): mer52c
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgatggcagtggctgctgccatcacgctggctgcagcagggaggcgcggctggggctgcacactccatggagccggtgggagccccgccccttctgagttgggacgggagctccccgtgccactgcagccgcctaaaccgcagctgcagacccaggcctcctgctccacggagcaggcaggagccccgccctcctgggcggggctacagccacccaaactgcggctgtggatccgagcctccctgtgctcttgggggagccgggagcaggcaggatctgccytcccgggtgcagctgcagctgccscacccgcggctgcagacctgggcctcycactccaggragcaggcaggagccagggacaagcgggagccccgccccttccgagttggcagggcgggagctcccgggtgcagctgcggcctaccctcccaggcgcaggacctgggcgtctctgcagcctgcacccttggggggcccaggaaggacccwccccatccctgcaggctcaggggtgtctgctcccactgcctggcctctctctgctcctggcgcctgctctgatctcggagcggggttggggccaagcccyggggccatgaatggcagcgggaggcagacagattcctgggcggaagggggcgggtccccagtaaggccccaccttcaggccagggagggcctgaaggctgggggccgggctgccagtcccgcagaccagagtggggactcgtggtgcctcttccgggcccacccatggccgcccatggaccaatcggcacacacttcctcccctctgaggtccataaaagccctgggctcagccagagcagggcagaggatggccagaggacaaagrgggcagagagacaatgggacwggatgaccagctgcagagaggagctaccctctctgctgatagctggagaygatggracgaccagctgcagagatgaccagctgcagagaggagctaccctctctgctgagagcttcagagacctgcagagatgacttgcctgcagagaggagccaccctctccagggcctcctctctgctgagagctgaacactcgatgggacgacctgcctacagagaggagctacccactcctctgagctgttctaacactaaataaagctcttcttcgtcttcttcacccttcacttgtctgcgtacctcattcttcctggacgcaggacaagaactcgggcaaaggcgccgcggccacagaggtttcccgccagaaaaatcgacaccccaragatcccgtaaca

SEQ ID NO: 188 - DNA, 189 bp, Homo sapiens
  repeat_region (1)..(189): mer53
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gggttgccagatttagcaaataaaatacaggatgcccagttaaatttgaatttcagataaacaacaaataattttttagtataagtatgtcccatgcaatatttgggacatacttataactaaaaaattattcattgtttatctgaaattcaaatttaactgggcatcctgtattttatctggcaaccc

SEQ ID NO: 189 - DNA, 902 bp, Homo sapiens
  repeat_region (1)..(902): mer54
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtagtgaattcttataattttatgttgcctcggcatccattttgaatataagtttaactttctcataccagaagcagggctyagtcacccttgacacggtttccagttctccacctcctcccagttcctcaatgtggtcgacccagatatctgccttatacmaccgcctcctggkgaccacctccctatggaacagctggatacaacctacttgacttgccccactgacccccacaccccacatggactgtgcaggtatgccacagtgaccacctctcagtcacagcgtgaccccacggaactcgtgcctgcttgctctaaacccaccaattagaactccccgcgggaaacctgcttgggtaacgccctggaccccaataaaggctttggtcccacaggtctctctctctctctctcgttctccccacccgttggttgagcatgcgtgtcccggacagcttcccccttcccattggccctgcgaggcatgctgccctcttctctctgggatctgtaagtaataaactgcttctgttatttcatgtgttttgttgtgctgcctcctctgtgtctcacctgaccgacacacccaaacctaactctcttcctggtcagggctctcctagagagtggctatcttggcaggaataaactggacacaggtcagacaagagccacaagggcgtctgccagtgtaaacaagtttcctgtgagagggacacctggtcacgggtcggacacctaggcattaggccgtccgccaggataaagaagtatcccgtgaaagatacactgtaaacacccacaaccamcttccctggagccccatcagggcagggctagagtttatagccactctccagagagagacctcaagaccaaattagaggaaaatacaaca

SEQ ID NO: 190 - DNA, 790 bp, Homo sapiens
  repeat_region (1)..(790): mer54b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtngtaaatwcttataattttatgttgcctcagcatccattttgaatacaagtttgactttctcataccagaagcagggctcagtcacccttgacacggcttttagttctacaccacacccaaatggctcaagccggtggccagagataaaaacttggaggcatctctcccgcctggcagactgggctccccactttcccgccgcttcctttaaaaagaccattcaggcatttgcccgcnaacttaaagtgaccacaccctgttcccttatatatgctgctagctgtcatgctctctctgcctgactcttcattcctgcctcgcgtgacccggggacggaggactgccctccngactcattgcaccctccctgtccaggacctgtaagtaaaaatctttgaacttgtttcctattgtggtggtgtattgaatttgcgccttccatctgaagaaccaggggctgccccaggctgggttttccccgggatgccagggagaanacaaggtcaggctcccagtgccagagcgatggtcaggcaggcataaactggacacgggtcagacaagagccacaagggcatctgccagtataaacaagtttcccgtgtgagggaccccctggtcgcaggtcggacaactaggcattaggccgtccgccaggtaaaagaagtatcccgtgaaaggcacactgtaaacacccacgtccagctccccttcattttccattagggcagggttgctagctgctctggtactggaaccccaatttagctgggggctctcaaaaca

SEQ ID NO: 191 - DNA, 398 bp, Homo sapiens
  repeat_region (1)..(398): mer57a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttaaattaagtttagcctaaagctgcctccttacatattttaagttcggcctaaaggtttctctgtacatagtgaactataacctaactggaggtgtaaacagaccgtagcctactcttgtgccaatcactgagtttcggccaatcacaggcagccaactgttcaaaccatgttcaaataaggcaaatgccgagctgtaaccaatccagctgtttctgtacctcacttccattttctgtacgtcactttcctttttctgtccataaatcttctaccacatggctgcactggagtctctgaacctactctggttctgggggctgcccgattcgcgaatcgttctttgctcaattaaactcttttaaatttaatttggctgaagtttttcttttaaca

SEQ ID NO: 192 - DNA, 434 bp, Homo sapiens
  repeat_region (1)..(434): mer57b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttaaagcaagctaaatatagcctgagaaggactccgtacttctatatttgagtccttgtggatgaactgtaacctagcttaataggcagacaaggttgaaaacctaacttaggagtatgcgcctgtaacaatagctgagtcttggccaatcccagcggccatacttcaaccactcanagactgctaagtgttcaaaccgtgttcaaataaggcaaacgccgacctgtaaccaatccagctgtttctgtacctcacttccgatttctgtacttcattttcctttttttttatctataaatttgttccgaccacgaggcatccctggagtctctctgaatctgctgtgattctgggggctgcccgattcgcgaatcgttcattgctcaattaaactcctttaaatttaattcggctgaagtttttcttttaaca

SEQ ID NO: 193 - DNA, 7488 bp, Homo sapiens
  repeat_region (1)..(7488): mer57i
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gatggcgtcagaagcgggatccgaagtagagcttctaacgacccccgggagcactgagcgaccaaagcgaggtasctgcwggacmcacttgtgtccattgatctctcggagcagctggggatcatggtaagttctctctcggatttcggagctcnacggatttgtgtttcgagctctccgagtttctttgagcaaatttctgatccaaactgggtttggaagtcgtgacagaaactggactgggtccaggantggattngatccggtaattaaccggcttggatccagttagaggnctcttacatctgactgggtcagaaagaaactggtagtaaatggtaatattgcagggggtgtaaaatttggcttttgaaaattcgcggggatttttgtgttctacccctttgtttcatttttcttgcacgcttaggtaggaaaaaatcattggctaagttgatcaagggaatctgagagtaaagccaatatttgaggtaaaaatgggatccttaatttctgaagaactgagttccttctggcttatacgcgcacaagtgttaggccccnaaagcggcgaagtcttacagaaatggcgaaatcttactaaagataacttasagtggaacgttccgaatgaacgacactgcactgaagtgcatttgaaaatgagggctcccaaattagtctcatctagggatgcctattgatatgcagaagcttctaaaaakatttcagtatttttatttaaagactttatgaaaggcaaataaaaagcttaagcgactaattgattwwaaaattaaatctgctaaccttttagcttagttactatcctcatccaaaggaaacagactgcagcaccaattggctgactttgggtaagtagtggggtacattttacctgagtaaaggatgggattgggttagaggccctcccctcagtaaagtccctcttggttaaaaatggatttggcactatgggatgttaaccgctattctctttggattaatctgccttgtactntttgctgacggctgtgagtgacaggattaggcatgtacaggaccatgggacatggggaactttttyctcctnaaaaggggaaacttgagagctgatgngactgctggaaaagatnccttcgtgaccgacaagcggccgcctgaacttttgattcagtgtcgctgcgagtgngtctttctctggcctccctgagctcctcgccttccccaccccgccacaggcaatgcttttctcccttcctctcctttccctttcctatcttttctgttactcagggcagccatcttgcccagagaccacatgttaaatctcctggtgggtggttggattaaagatgacagggcccaaccgggggcaagtttgagccttgccagttcgatattgggcgctgagcggggtggctaatgtctatgntttgtcacatgtattttgctctggccggaatggaaaatgttaatttggttaccccatgcarcccgttgggcggcatcttgcaaaattgagaggcttttgcctgtggttccatgaaacggaaaaagatgattttcttttgtgatgtggcttggcccccagagctatggcgcggngagctgggtcatcaaagctgctcagggaaggggaacccagaagcctggcacgctggcaaaagggtaagaatttcttaccagtcaggcttctggcctctctctctctgtgcaaactggytgaatgaatggtaaaaatcactgtttatctcctctgcaaagttttgattaatgggaaaaaggattcgcgaggctagtcttaagctgtagcgaatctggtgtgctttgtgcgtctttctgtgtcgttctgtcataaagaggggtaccttaggatagaacacgggcttaaaaccccataagctcgctgctcaagacggcccagcaagctggtcagtaacaaactttgctgcaggtccctgaaacaaacaaaaaaactggatgaggtctccatcttgttttatgtctttgggagcttgaccttgtaaccgtgtggcggtactttctcttggtctccgccwtccagggaacaggaattttggggttcatgtcatagttagctctaaaaattatcttgagtagttaaaagcctttgcaagctcaaaattgactgctctagactccttccgggaagggcaacggagactgcccagtgctgtagctcagcagctaaggcttcgccattttacaatggtggcccgggttcaatcctggcttagggaatgagtactttctggttgatatctgtgtgacctttaccatttgttgattctcttcccctccacgaacaacttctagctttccttcttgaattttcctttctctgagctacccttgaagattctagattttgtagaaactncttaccacctctttgaaaatatctcgtacactcgtggttnagtnataaccttagttgaggcttgttggtttcacctgggaggttacttttggtaaagttcaaargccagaaatattggccgtttggcccggctaaagtcgggtaataagnaatttaaaaggacttttwcttaaagagcgctgtggttaaaagtcagcttaattaaaagtggatatccaagctatacgtatatttaaaaggcctttatgtttttttttctcttcttggmtcttatttttctggaaaaggtttttttcttttcagtcaactgaattrcttttctccattttgtcttctcgccactcttgatgcacgcatgagaggacctaagataacttctaatagcctgggactcctcgggaaaaacagaggaggcgccacagaccccgttttgggaaaaaactctgttttcctcatgaaaccccaggaattgraagcggatagatccctctcaaaatctaaggctctgttctgttttgcattgtgttatctgacggttttgagttttgggggtatcagaaattacttcgcattatgagagagctttggtgtgtaataactaggtrggaaatacacwtttagggatggctaatggcagttatgggggatactcggctctttgcacatttggatnagagaagcatgctcttggccacctggaaggtatgaaaatgtccccaccccccactgagagatgagactcccatgggggatgggctgattacaaaatgggctaattggctttgggttgccttgcaatgaaatgcatggtaaaagcattgcaccgtcttctcccatagcatttcnntctttttggggatccaggatccaatataaaaatgggaccnttaattttggggntctgcttgccttccagctgtgcctgcttattaggccctagaaactgcatgctttcctggccctgttcctcgaaggactccgccctgaagccagtaatccaattaagaaacttaaaaactggcaaatgaaaaatcttacaactactggatcttcttcaagagctctgattaattggcttaaagaaaaataagcgcttaaatcaaatattttgwmagaaaaataaaaactstaatgccttttagytcacgtgactttagtaatctttgggaaataaaaacagttttwaaagattaytggtaaaataaagacatttggtctaaattaggcaggtcagatattaggtttgctaaatgctttaaggtcataaactgcttctttgacttttgaaaattgttcaacttacctgctttggagccattagattctagataaggcctggggacatgtggagttagccatgcccctagctatgctggaaagagtcggaccttatctgcacttctgtctgttgtcctaggctccaaacctagtacataattaaaatcacttaccaggtttttcaccaaaaataaaaattgctaagagttaacattgtaacatgtaattgagactactgaaaaaaacagttttacatgcaaggtgtgtgaggaaagtgaaatgtgcttttggtaaaagattataagaaggcatgggaatgtacatttttgcctagtttagagggttaaaggattgttttaarttagataggataaagctgaargtttgagcaagttgtggaaggtttgtaaaaattaatcttgtaaaagaaattctgcgtgtgaacatattggctaaatttaaaggggtattattcagttttttccgtaaattgaacattgraataaaagcacaacagggttttcttagagcactgatctgctctttaacaaaaatttgtaaagggttataaaaggtttatgagaatctcaccttatggtcaaactgattaagattggatagatttgtctataaggttttattaaaaattggggttgacattaatagtatactaatgcaagggtgaaatttggctttctctcttgaacgagattttcatgtaatattaaaggataatgaaagatttttgtttgccttttgaataaactacwggaaaagaagggaaagacaagagacagatcgtttggaaagctaagtctttcctctatcaatgagtaaaggtttttgcctttttaaaatttktgagtcatcattttggcgaaatgaatgacttatggtgacctggaattctatttcataatatcaagtgttttaaacctttaacatatttgacaggcttctcaaaatcaaatttcagcttcaaaattaagtcttttttgacctctaactttgggatgctacagagggctcctgaagcatccaaaagagagataaacaggattatttganatgttaagttacatgggaagcatcgtcaaaataaaaataatgtttaaccttcttcaggttatattttagtgaataatattaatatatgttccaaaattttatgggatttctaaaattctgatatgtctgagtatatgctatcaatcataattatggttattatgttaakttattgtagaccacagaaataaccaaatttccttgtcaattttgtctttaactwcgactatttaaagtcatttccacagktaattgcttaatgctgatgcagtttctgaaaatttcacaagcacgcaaaatcctagaatatggtgtcttttaggaggttcgtgaaaggatggaaaggaccccgaaaagcgctcttgaatacaggtttctaataactttagaatcgcatcatttggactgggtaagaattcctggaactttaatgaaaagactgactggtttataaaactgctaacccaagtagaacaaaaattaattgaataccaagaagatactttgccagattatcatgctaaatcagccaatactgaaattgtttagatatacaatttgaatgaactccatggtctaagtcaaatgacctatgataacccatcagttatcagtgctatgcacctaaatcggagaaacaactggtattcaagaggacataagtccaatgttaagcatggactcatggagaaccaggacggctgccttgtccttcctgagtccttaaagcttttgttattaaaagttctgcattccatgactcatcatggaaaagataaaatgatccaaattaaatatatattggtgtggtgacttntacattgctaaaatagtttatgaccaatgtttgntttgtcaaacccatattcctgggaagacaatcaaagcttcaggtacattcggctacctgatgggccatttaaacatttatagagggatttcattcaattgtcattttcaatgcatgttttctggttgtataaaagctttcccatgcaagagggstgatgttataacagtagattattacgccacagtgtattttcaccaggtaaagaaagctttttatgattcactgactgaggacaatcagccccttcacaatctagaacccaaagactggatcttctgagaacatcagagaaagactgcccttgccatccacactgcagcaaaacttcgggactttgaaccttgggttcataatctcacaactgagaagggtccctccacactcttggaactgtacacccgttggaacccttaaggtaaagctaaccagggaagtttctccccagaagaagatgscatccttgatgtgaacagcttttcccaagatcacggatcaagacttctctactatcatgagactcttatctttaaatatttttcccttgcttatgcctctatgaacaatagaagtgaaaagggggtctgttgtgtgcacttatgtggtatacttttattcgtgaaggattttgcagccagccttatacgtggataaccttataccttgatagatgaaagatgaaggcccaatgtaggtgagaaactttaatggtacatacattgcctcgtaatcagtcagaaacagaacgttggttcactcctcttaacccacatcatgggttaaagagaacgttgccaggaggccttcactcttctagaagggcatcattcgttaggtcmtttttccgtggtttggagtaaaagaggcaatgattagaaatgtatccctcatgataggctctatagcagattctactgtaaaggctatggttacacaacagactttaaattctcttgtgaaagttatgctaaataatagaattgctctagattacttactggctaaacagagaagtatctgtgcagctgctggcgcttgtggcctatggagaaatacawcacattaggtattatasagattcagttgtaggggattaacgaagagaccgcttagttaagcgagtagactctttatctagctcattctttgatctatttgattttaggtggtttggtttatggggaccctgggtaaggagcatactccaaactcttggtattatcctcctaatagtcataatagtagtctccctggtgcgctgtattctctcgaaggttttaaatgtttgcatgcagccatctctagaatgtcaaatggtctctcttcaactggaatgacaagagctgaaggaaacgtgtgaccatgagggcaccataacctatgaatgacatgctgagaccagaaacccaaaatgatggtaactgagagtggcgctaaggccctaagttttggtcacactctcacctaagtgagaacctgaccaaaaagggggaattttttaaaacaaaattatgggaggccattgttttggactgagctcatgcactaggccccaacagaccaraccaaaccaaaatggagtcgctcgtgctaaatgtgacataatcaaactaagactttaaggaaacacatagatcctagaacagaccaggttttgtttttctcctgtaaacagaatgttccagcataaggaggtaccctctactctaacccttacaaaaaaawaatgacctgaagtccttgttcccaccttgcaaaacccactgttctactgtttcccagtgggtttcaagaccaaataagtacatttatgatggtgatagtgacatcaatgactaaagttttggtcaatctctcaaaattgagaaaatgaccaaaaggggggaat

SEQ ID NO: 194 - DNA, 189 bp, Homo sapiens
  repeat_region (1)..(189): mer5a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagtggttctcaaagtgtggtccccggaccagcagcatcagcatcacctgggaacttgttagaaatgcagattctcgggccccaccccagacctactgaatcagaaactctgggrgtggggcccagcaatctgtgttttaacaagcyctccaggtgattctgatgcatgctcaagtttgagaaccactg

SEQ ID NO: 195 - DNA, 178 bp, Homo sapiens
  repeat_region (1)..(178): mer5b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagtggttctcaaccytggctgcayattagaatcacctggggagyttttaaaaatccngatgcccgggccacaccccagaccaattaaatcagaatctctggrggtgggacccaggcatcagtattttttaaarctcyycaggtgattccaatgtgcagccaaggttgagaaccactg

SEQ ID NO: 196 - DNA, 866 bp, Homo sapiens
  repeat_region (1)..(866): mer6
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagcaggtcctcgaataacgccgtttcattcaacgtcgtttcgttataacgytgatgagraaaaaaatcgattcccggccggggccactgtctgtgtggagtttgcacgttctccccatgtctgcgtgggttttctccaggtactccggtttcctyccacatcccaaagatgtgcacgttaggttcaytggcgtgtctacatggtcccagtctgagtgagtgtgnntgtgtgtgtgagtgtgccctgcgatgggatggcgtcctgtccagggntggytcccgccttgcgccctgagctgccgggataggctctggccacccgtgaccctgaamtggaataagtgnrttgraaaatgaatraatgaatgartacgaattattataaaataaaaatttgtaaagtctatgntaatcttacacatacatgacaatacatgaaatggtaagaaagtgatcagtgagcctgccatatatgttattgcttgtttctgaactgagtggtgggaggaggtgttcctaacaatgttcactttgcagacatttatttctttatttaatccattatcactatgaccactgtcattcagtkattcwccaaaaattgggtaaataattatcwtryttgtttttattaatctttcttaaatgtatgtatagctcacatttatttcagtgtttaatattagaagtgttttgggtctttatttagaagtttggtgatgtttttgtgaccagaaatatgccataggaacttaactcttgtttatatcaattagcctrtggtaaaattggtttcgttatacgtcgtttcacttaaagtcgcagtttccaagaacctatcaacgacgttaagtgaggacttactg

SEQ ID NO: 197 - DNA, 837 bp, Homo sapiens
  repeat_region (1)..(837): mer60
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgcagrttgctagtgccagagggagcaaagaattgtgattgtggattttaattgctggcagctccctgaaggactcacaagtctttttttctcggctgaagtggttcaaaaacatttaaaggcacatttgctggagcaagggacaacatgrgrcaagcaayagatagaccaaaaagcctaagaaggaagagmtgagaaataagatgcttggggaaawaagggctttgaaaagtccacatattcctgggaatctagaaggccatgcacatgtccagggctggacacatgctcagaaaagacctaagaaggccctaagctttcacctctggctgaccttnagactctgtacaagcaggaagtgaaggctaaggcagagttgtaaactgccttggctgagtgttgaaggaatgccycaacacacagmcaatctgcaaagactaggagactttttttttgtgtttggtddtkttgttgttrttccaggtatttaaggaaayctctgtcaawyactagctgaccactaagctaaycgarcagagacttcagtggccacacatgacaaagaatacagactttacaaaattagtttagaaaagtcactaaacaaacaayacaacagcamayaayaagcaacaacaacaaaccctggaaaggggagagaatctgatttccagagttgccacattatawtatttaaaatgtccagttttttttttcaacarcaacaaaaattatgaggcatacaaagaaacaaagaaaagtatggcccatacacaggaaaaagaaattaatagaaactatccctgaggaagcccagacattgracttactagacaa

SEQ ID NO: 198 - DNA, 354 bp, Homo sapiens
  repeat_region (1)..(354): mer61
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tggtagtgagacagccagatgggaaggggtccccggagaaactccaaccggcctgcgcactgggaggartgcgcactggggtggagccacagaagttcgcgccatttgcagcggggaggagcctggcccctcctcttcctgggtggaacctgggattcgaactgcgaggcgggaagtscactagcaggaarcacagtctctcrctttgctgagrgtccctgtttccccttttcttccttttcacysaataaaaycycgycttactcacccttcaaattgtctgcaagcctaawttttcgtggccgtgtgacaaggaccccgtctttagctgaactaaggaaaagtcctgcaaca

SEQ ID NO: 199 - DNA, 425 bp, Homo sapiens
  repeat_region (1)..(425): mer61b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgatagagacaggaggcagccaagggtcccccggtgaaaccccaccttcaagcctaaaacagcctgaaggctgaaaaaccagactgctggtcccggatgaagcccaccctttcctgactgattctctctgaataatgcccacctgcgcactgggaggacggggtggagccacgggaagttcgtgccttgtgcagnggggaggagcctggcctcttctgttcctgtgtggtggcctggggttcaatctgtgaggtgggagcctgttggcaggactccctctcgctttgctgagagttgtttttcctttttccttttcgcccaataaattctgctcctcacccttcaatgtgtccgcgwgcctaatctttcctggtcgtgtgacaagaacccagttttagctgaactaaggagaaagttctgcaaca

SEQ ID NO: 200 - DNA, 434 bp, Homo sapiens
  repeat_region (1)..(434): mer61c
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgatagatgcaggaggcagataagggagggtccccggagaatctccgacccgccccacaagtgtttacatcagatgcttttgtgcagatgagggaacctgcccagggccttgtctgggcatgcccacaacgaactggggggcccacctgcgcactgggagaatggggtggagccaccgggaagttcgcgccttgtgcagcggggaggagcctggcctcttcagttcctgtgtggtggcctggtgttcaatctgtgaggtgggagcctgttggcaggactccctctcgctttgctgagagttgtttttcctttttccttttcacccaataaattctgctctcctcacccttcaatgtgtctgcgtgcctaatttttcctggtcgtgkgacaagaacccgggttttagctgaactaaggagcaaaatyctgcawca

SEQ ID NO: 201 - DNA, 5217 bp, Homo sapiens
  repeat_region (1)..(5217): mer61i
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tttttggcacccaacgtgggggcttgagaaagggtgagtgagatgcaaaccaaaaaatctttttcccttttgcttctaagccttttcatccttggacttctgagggtaggggaaaccatgcccccacccccatcactcccaggggtcggaggcctttccatggccttttccttcctttttcgggatggaccngtgagcagcggctcccccctccctcccctccctgctggggctgggacgcatggcccaagggtccccagkggcatggctggcgttctctgccacrtrtccacagagtcttcccctcccctggccaaggagttcagctccatcngacagcaattaagcttctctccctggtggaggaaccatttgcataagaataagaggttcttccccaggcatttttaaactgttttttttcttcyytttctccaccctgtcagcagttaacttttaagtnagkttttttcttttagaagatgttttactaggccaggaatcataaggatcactgtttatattctctgtaaagttttaattgtgaaaaaggatttgtgaggctggtcttaagctgtagccaatctggtgtgctttgcatgtctgtatggttcgtagcaaactttgctgcaggcctccatcttgttttacgtccttgggggcgtggcctgtaaccacgtggcaaggcttttcgtttagcctctgccattttayagtggtggcccgggttcaatcctggcttagggaatgagtcctttctggtttgatatctgcgtgacttttgccatttgttgattctcttcccctycacgaaccgccttgaattttcctttctctgagttryytttaaagsttytarattttgtaagaactgcttamcccctctgaaaatacctcatacaatggcagttaaatcataaycttaattgrkgcttgttggtttcacctgtgaagttacctttagtaaagtttgaaagccagaaatattggccgcttggcgcggctaaagtcaggtaataagggagtttaaaaggattttcttaaagagcgctcagcttaattaaaagtggatacccaagttataggtatatttaaaaggcctttatgtttttcttttcttggatcttgttttgctggaaaaaggtttttttctcagtcgactgaattmtttttctccattttgccttgccactcttaatgcacgcatgagaggggagagacctctgttttcctcatggaaccccaggaattaaaagcggatagatccctctcaaaatctgtttttgctscawytatrcctrtttattaggccytagaarctrcatgttttcctagccctgtctcttaaagggccccacccagargccaataatccaattaggagattggcaaacgaaaratcttatggctactgggttttcttctgcctgtctgtgtagttatgtatgtgttgtgtgtgtgatgtctataaaaagagctctaattaattggcctaaagaaagacaagcacttggatcaaatattttttaaagggaagataaaagctgtggtacctttcagttcatgtgactttaatctttgagaaataaaaacagccttaaagattattggtaaaaagcagatgtyntcaaaatgtaaataggtgaactaaattatgcaggtcagatgcaaggtttgctaaatgttttaaggttataaactgctttttgggttttgagaactatttgacttgccggcttcacaactggtaaggcctggggacatatggaactaaccacacccttaattatgctggaaggagtcaaaccttggctgcacctagcacacaattaaaacaacttaccaggttttacattaaagttaaaaattgctaggagttaccattataacatgtaattganactactggaaatagatttacatgcaaggtatgtaagaacagtaaaatgtgtttttagtaaaaggttattaagaaggcatggaaatgtaaattyttgcctagggtaaaggattgttttaaattagataagaaaaagctgaaggttcaaacaagtggtggaagaattgtggaaattaatcttgcaraagttctctgtgtgaacatattgactaaattcaaaagggtattatatggtttttctgtaaattgarcattgaaataaaagcacaacaaggtattcttaagrcactaatctgctctttrgcaaaatttgtaaagggttataaaaggtttttgcttytttaaaatttctgagtcatcattttggcaaaataaataayttatggtaatctggaattctatttcataatatcaagtgttttaaacatatttaacagscttcccaaaatcaaacttcagtttcaaaattgtctttcctgatgcctggctttttggatgcttcagagggcccctggagtatccagaaaagagaggtaaacaggattatttgacatgtttaggtacatgggattgccaaaatgatgttcaatcttctttaggttatattttggtraataatactaatatatgttccaaaattgtatgggatttctaaaattctaatgtctgagtatatgctatcaatcataattaaggttgttatgttaagttattgtaaaccanggagataaccaaacttctttgtcaattgtgtttctaactgtaactaccctggacattttgttattcacagacaattgttgtcttgttttaatccttttcaaagatggtttataataagctatagaactttgacaggtgctctcaaatacaggtttctgataactttggagattgtaacattggaataaaggaaaatgtacaggactcatgaagagctaaaatgttcacgaatatcaagcaaaacaagagttaactaaatggactgaactcagaaagctgaagcaatctttttgacttttgcttggaatattgctgatccttgttttgtttttcagagtcaaggaaacttattttgaactatttatggcctttaataattgagtaaggtatactcctgtgaacaaaatttggagcatgtttgtttctctctgcctggttcctctagaatttggaaactatctgtgagtattcttaacttatggcaatatagttgtttgcatcaagtgcaataagaatccatttttcttttgcaacaggacrcaattggagaaastggttattttaccaaggctttgactggaagggtatgcttccctttaaggagtcaakcttgacttgcagagccaataaaagccccktgggaaaactggcctcatacccttgtctacacagtccctgtacagggttcctgacctgtggtcagtaaagaatgtcactttctaacaggyccaggagctccaagtttatcttgggaccttaagaggagaggatcacccaactcacaggtatttgaggatacaaacccatggctgggctcagctttaaaaggtcttatctgagattccttgtggaacagagttccatcaaagccaatctaaaaggcctatgtagaaatarttattcttgctgcactttatgcaaataatcaggccaagtataagactaaagtctattttgcaaacaactcagtcctatcatgattttttttaacaaaaatgaggactggagagagagaaattatgtttcaaaacttatcatacatttgtcattaaattctaaactcattagttgtttttaagtttttgcctacattttagactaaccctgcttgttcctgtgaaccaaccagcaatctccggctgcagctcagaaagaacaaaagggatgggtaatgtagaaatctggatcaatattctagttctgagcaattatcctgcaaatcctgccaggtgatgggaataaataggatgcccatcacttggaggtttcctttttgggaaagtaagaccaagggagctaaccaaagccaagcaccatgcacccaaatcttagcaagcataactatagccaccagttatctgggtrtgtcacaagacatccttttctctcccttgttggaggaggactcaattccacagtttcaccttagcatttagcttatgataaggagtccatgcaacccccccgagacacatttttgtcccaaactcaattccaagcttygggtcaaagccctaggaaggaaaactggatctgagggatccagaggcagatgataacagaagttaaaaggcacagtgcaggtgagcatggctgattcctgccgattaagccaagcttcccgtttcatggataaaggtcatgttagtatccatggcataaatgaggtctagggaattcaaggctactgacagcaggggagatagggcatacgtgggtagagcggataattcccatcccctaggcccccctgcttcatgggtgcaagccgctttgacacccatggtggcacctgccaaggtcactgggactcggggatgcaaggacggaagagggaaagaggacgctcttccttctctccctcacgtaccctgggtatctgctaggaagagaagggaaccagggatgcctgctcccctctttctagatgggtagccattcatcttcagtctgtacccctttcgaatgcatcctgaacccctgggactcctttgaaaaaatgccttcttttttcctttttcctcctctgttctctcttcactgataggtaattgtgtctccatactatgggacactcccctcagatgcatcctccaaactggaaagagttaatttcccaaaccttaaactggttggcttaggattgggctcaggggaagggaacccagaagcccaacatgccggcaaaaggtaaagtttttttttnnttnntttgntttttttttgtttttttctttttgtttttttaccagtcaggcttttggcctccctctccctgtgcaaactggtaaaaggccttgggatttttgagctgtccttacccctccccttgtttcattttgatacatgttttctaataacctggtttgtctgttcttgccttcaggccatcaaactccaaatggtcatgcaaccrgagcctctgacaatggccccttctgctrggaacccttagataggcctctgagggagatctgactgccgttttcccaaaacagtgccccctgtcagcaggaagcagttaagattggtcttcgtccttatccttatccttattctaatggcagttagatgtacttctttagaggggggaa

SEQ ID NO: 202 - DNA, 211 bp, Homo sapiens
  repeat_region (1)..(211): mer63a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ccagtggtgtgctggtaaatgtttaacaactggctctctgggggarngaaaaaaccctgatttgtagcgtttgccgatttccgtggtgtaaatactcccaccgtggccgatttcaagctaccaacgtgatgtcactgaatgsggagttgggaaaagatatacacaatcgactctcgtgagccgatacgagccagctccagcacaccactgg

SEQ ID NO: 203 - DNA, 439 bp, Homo sapiens
  repeat_region (1)..(439): mer63b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ccagtggtgtgctggtaaatgtttaacaactggctctctgggggaaagaaaaaagccctgatttgtagcgtttgccgatttccgtggtgtaaatactcccaccgtggccgatttcaagctaccaacgtgatgtcactgaatgsggagttgggaagagatgcacagtagcacacyattatatagtatttccaccatacagatacaatagacgtaaataacctcaagagcatagataatagtaaaatgtagtaaaataattaggaagtgatgagttttgagtatttattacctttgtttttaatataatttatttaattgtaagtttatataatttaaatttctttgtttttaatataatttatttaattgtaagtttatataatttaaatttcaatcggctctcgcgagccgatacgagccagctccagcacaccactgg

SEQ ID NO: 204 - DNA, 938 bp, Homo sapiens
  repeat_region (1)..(938): mer63c
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ccagtggtgtgctggtaaatgtttaacaactggctctctgggggaggwaatgymtkgatttgtgtattcacatatataagtttattataaattttactgatataaaggacgtrtagcacacaatttacaaataacaataaaatatacaatattctttattgtaaattccatatagccagttgattctcacagaatgctttcgttgatttttgcccaaactcttgtatccgtagccgaactatgtttgtaattgacgaacaagtgtagttcnaacatgaatgttggttgatattttcgtttatgttaatgagtaagatgaaagtgaaacaacgaagacgtatgtcagaacttcactcatttgtcaatgatgtgagtgacttctttgctgaatcggatggtagttttcaaacattagaagaatattttctcaatttttggtgctattcgcaatgtaacagctacagacatgacacacttttaagtttaatctgcatcattaacattttctccatcactttcttaagtctagacaatcaacaaaacaataaatcaagccctgatttgtagcgtttgccgatttccgtggtgtaaatactcccaccgtggccgatttcaagctaccagcgtgatgtcactgaatgsggagttgggaagagatgcacagtagcacacyattatatagtatttccaccatacagatacaatagacgtaaataacctcaagagcatagataatagtaaaatgtagtaaaataattaggaagtgatgagttttgagtatttattacctttgtttttaatataatttatttaattgtaagtttatataatttaaatttctttgtttttaatataatttatttaattgtaagtttatataatttaaatttcaatcggctctcgcgagccgatacgagccagctccagcacaccactgg

SEQ ID NO: 205 - DNA, 445 bp, Homo sapiens
  repeat_region (1)..(445): mer65a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgaaagttgtcagaatcaaaatggagtcacttatgttaaaaaccctaacaaayagagccggggaaggccatgaagagagggttctcacgcwcatatgcctgataacaagaactatcacaaaagactgcaaaaaccacaaccttgcacaaaggccatcacaaccttacacanaaaaatacttctacgaggacatctgcccagcaactgcctgtccaacctcggactggcgtcacccttgttattgatccttgtagccaaggataattatctcaaaacaattatgtaatcctcctcatttttcctttaaaaacctttgtcttcctttacctccctgaatatgcacatagtttactatggcacgcgtattcccattgcaatgctctattcccaaataaatatcattttcttttagagagcctctctgtttgttatttaggttgaca

SEQ ID NO: 206 - DNA, 531 bp, Homo sapiens
  repeat_region (1)..(531): mer65b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgaaagttgtcagaatcaaaatggagtcacttatgttaaaaaccctaacaaayagagccggggaaggccatgaagagagggttctcacgcwcatatgcctgataacaagaactatcacaaaagactgcaaaaaccacaaccttgcacaaaggccatcacaaccttacacanaaaaatacttctacaaggacatttgcctgacaactgtctcacraacctagctactgcaagagcctactgtaactctaagattacaaatcctacctagcaactgccgacactcgccaatcagagctcgccagctcttstaagacgctgctagcgccaatgaactttctttcaaaacaayttgtgtaaccttctctttccttaataaaaccctaacatttttctttgttctctggacataccgaaggccacctggtctgtgtgtatgccccaaattgcaattctgttcttcacatgttattcccaaataaaacgttttaaatttagggattcgtctctacattttattttgacttcgaca

SEQ ID NO: 207 - DNA, 461 bp, Homo sapiens
  repeat_region (1)..(461): mer65c
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgaaagttgatcatacgaattgggtcattcttgtcatacccaactaaaaccagggccgaggggcccagggggaaaaggcactcggggcgcatagcattgctccaaaatataattctctgcaaccctggctgctgaaactgcctgttgtaacctgaaaccagttttatctaacagctactgaaacaacctactgtgactctaagactagttttacccaccaccgtcactcaccaatcagagcttgccagctccccaaaactttactagtgccaatgaactttctttcaaaacaatatgtaacatttctcttttttataaaacctccaaccttctctttgttctttggacataccgaagaccacctggtctgtgtgtatgccccaaattgcaattctttcttcccaaataaaacgttttaaatttagggattcgtctctacattttattttgacttcgaca

SEQ ID NO: 208 - DNA, 4871 bp, Homo sapiens
  repeat_region (1)..(4871): mer65i
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gaccaagacagtgttagaaatgagttcaaaatgaactcacctcagacaaatcttgacctctggaattgaatgcagcaatgactgagtcctttgtactctctattttcgtgagttccttttctgccctggcgaatcttctctcagattctcagactccctccctttggtgagtccttttttactttattccagatctgatttagttaaaagaccactttaaataaagaatcttacatcccttctgggaccataagtcttttttgacaagcactttctgatataaagacaaggatccttctggtttgagaactctagtttatattctgtctgtgagacatttattttctggtaaattcacttttgtttctttgtgcctgctgtgagacatttattttctggtaaattcacttttgtttctttgtgcctgttttaatattttgtttgatgtataaacctggctaaaaatttttgtgaatattctgattttggtgtcattttggtttggttacatgtgtctgtaaatgatttggctcttttttaccttatttgtttctaaacatcttccaagagcaaaaataaccattctaaatggtgagtgcaagacagccaattaaaagctagtagggtagtcgacgccatcgaaaataccagtccaaactcctgacattccctgacagtactgataagattttctctggtctcaagaaaaaaaagaacaggattctcaaaattctaaggcacgccaagtcttctaggactctagccagctatacattatggtctattctcgtgcgcgttytwmaactgatgggcaaacnacatcarnaaaaacncagaactyaaacggcmattwtctstctaagcttrtyaaaaactrcaaccaactatagagttaacatggagmrycttcatawgytctytgtctctctctnttttttctacccgctttgaatctgctgacttttctgccagtattaagataaactcattgcttatgggatttcagccaagattttytaaaaagagtytcaaaggactttcaaattaatgnctttacaaattacaacagctccatggcaacmammaacctagacaccytttggaaatgtaaattkaggtttgcctarctaacaattgctwagggcgatggaacagytaattaaaagattgatagtctaaaaagraaagaactagataaatgtttatraaagytaarggctstcagatcaaacaggtcaaaatcttnagctcanagcaataataaaaggtatctctgtctgrcataaaaattgctttstctgccacataggrgccagaaaragctgaanaaaaawaayaactgtaaatatctttttgaaaagtgcctttcccacgttaactagtcaaaccagactaacaaaaaacagatttgttactaattcaaggycatctggaaattttgtttttcttatacaattcagccagtcctagytaaaatgtaaacatttgaatattyaacctctaaactcanttgaatcnaataaaaggawwaaraggtttttaaaaatcaaactgccatgraaactgctttacccaaaattttggtccacagccttcattrgattacctatcggggcaaataaagcttagccacgnaaacargtcccattttgtcaaaaatataatttggatccaactgtcattttataaaccggcgagtttrtattactatgttttactgtctcatgactaaaattctaaaatgaaagctataagatctttgtgtatgtatgyatncgtntytatgtatgtttacayatattrtatgtrttgcatctaswtgataaaatctgacatagttarccagaattcccttttaaaaattctatttagattggcttaggtaaacgagcactcatrwaaawtatatagtaattaacccaaatgctttttagttcacgtgacttaagtaaatctttgataaataagtcggttttaaatttgttaataaaataaaaataaaaatatcttcaaaantgtcagcatacatttttgycyrggtttactgntnaganangattatatttatctctactagatgntttaaggtnataaaagtataaatccagmctaaaaacanaatnatctttgtttgtatanctttttgataagactaagactaattcgataytgttagtttaatgaaaacaactgtatyttctgtgttatcggcaaaatgcccatrtatttaagtttrrggctcttacttaggtgaacacctgatattcacaggctataaaaatgrttaamarggaaataacttgaaatgacgactagctttgtytamtatcttagttttcataagtaatcyagrtataattrttaaaaatgaataaagtacgtaaacgtaaatgagataaatgtgtgtaggtgaaaattctgtatagtttaaaatcttaaagttatgctatgttaaattaaatgatactcataaaatgtctaagtcatttccaaaattatatgaaaagcattttcaaatcataagtggtaaaggatgctaaacctttgctatgttatatttatggatatgttactgatatgattgttccagaaattgtataaaactctcagaaacctaatatgccataactctagttattatgtcatataccacagaagtaatgaaccttttatgtgagctgtgttatcataatgaattctcatcagagttttagccatagtcatttaaaatctttatcattcattgttattgttttgatttttctctaaaagcatttgcaatcactacatccaaaaatgcttccttttcaaggagatttatggaaacgatcgtgacaagaactctttaatacaagtttctgataaatttcacattataccaccgactgtctaaaaattcttcagaactctaataaggaaacagatgaatttgtgaaactacttctcagtgtaccaagcagggaaaaatattgatttcattgaaataattgataactgatgaggataatgttttttatgatttttatttgaaaatttgctgattctttacttaaatgttttgttttccagatctatggaatttttttcttttaaactgtttataacttacagcaatctggtaaagtatacttctgtgaaaacaaaagtaaaaacatttgctttttctccctactcgatccctccaaaatttggcaactattcatgagaattgatatgtttatggtaatacagatatttgcacaagtacagtaacagtctgctccctctttgtagcaggatacaactgagaccattggttatattaccaaggctttgactgggatgttatattcaagatagaatgaaccaatatgaactgcagggcaaagtctgaagtcaaccttggtttaagggttcctagacttacagcgggttgtaaaagtttaatctgagattccttataaaaacttagagcaaagaaaattttaaaagagagcctacatggtccattgtctgccttggtttggcttccctaaagaatcagaccatgtttgaagtaactcaacctattttgcaaacaaacttattctactgaaattatcattggtaaaactagagatgcccatagagagaaaagttatgtttctaaagaaaaactgnaatacgcctgttattagattgcagccctgtgcattgtttccgwgyttttattatcyacmtgwagackggacwwkaccccgaattctnctagyttcctccaatncmattttctcccatngaatcactaagarmaagacctactctgttcctgaagccctataagctgaagntggamaactcgatgtaaatwtcmwgggacaaamtctcgtncctgatgtgtgggccacacmragagttcaccaaaccgctcgatgccataaccagagacactcaaactgcaaaccaggacaagaagttgacggcttcacgctgtggacagtttttcccaagatgtcagaacaagactccccatcataatgangctcttacccctcttaaytktcctttcttatgcctgcctttttgacttggcaggataatggtgtaattgaaatttcacaatcagtagcttctgtcagtaacctcacagaacctgacctaagagatccttcagcccccctagtgggtgactttgggaacatccctaatacaactggtgctcactctgctttaatccaactcagtcatgggacactagatgataaaattgctctaaattatctattggttaaatcaggaaatatctgttctattgctaatagcacatgctgaacctggataaattcccctggggaacttgaggccccatatacacgaaattacaaaacataggttataacaggtcacataggttataatgggtctcacccaattccctatggtcatttgatttattcaactggttgtctttaagcctaggttcatagctcaaaactattatgaaaactgggggtatcatattactactaatattaatttgtattttccttttaacaatttgtacttgttacttgtgaagtctctgcagaagtacaactcctaacagaatcgtgctggcccagcgcgtccagatgatggccaaaagaccacagaacagaaaaaatagaatttaacgatggacttcaggtagacttagtctgagtgcaactctctccaaatttccactttgctcaaatgtggctaaatgagctctgacactgactcctggtcaccagtcacttcctgatgatgtggaaccagaccacaccaaactgggacagctccatcccagcaccaaggggcaatcaaagcctgactgcaggatgactggtcagctatgcttttggagaaagatctcaattaaaagggggaaa

SEQ ID NO: 209 - DNA, 478 bp, Homo sapiens
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagataggaggtgggactcgactccggaggcggggcttgaactccagaccagattgaagactagctgaaacagggccagggcaaaagcacctctccataagacacacccaccggtgccawgtgagtttaccattgccatggtaacagccagaagttactgcccctttccatggcaatgacccggaagttaccaccccttttctagaaatttctgaataacctgctccttaatttgcatgtagttaaaagtgggtataaatatgactgcagaactgcctctgagctgctactctgggcgcactgcctatggggcagccctgctctgcaaggagcagtrcctctgctgctgctgtrcacagccgcttcaataaaagttgctgtctaataccaccarctcgcccttgaattctttcctgggcgaagccaagaaccctcccgggctaagccccaatttgagggctcgcctgtcctgcatca

SEQ ID NO: 210 - DNA, 486 bp, Homo sapiens
  repeat_region (1)..(486): mer66b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaggtaggaggtgggactcgactccggaggcggggcttgaacaccagaccaaattgaagactagctgaaacagggccagggcaaaagcagctttccataagacccacccaccggtgccawgtgagtttaccattgccatggcaacagccagaagttactgcccctttccatggcaatgacccgatgacccaaaagttaccaccccttttctagaaatttctgcataaaccgccccttaatttgcatgtagttaaaagtgggtataaatatgactgcagaactgcctctgagctgctactctgggcgcactgcctatggggcagccctgctctgcaaggagcagtrcctctgctgctgctgtrcacagccgcttcaataaaagttgctgtctaataccaccarctcgcccttgaattctttcctgggcgaagccaagaaccctcccgggctaagccccaatttgagggctcgcctgtcctgcatca

SEQ ID NO: 211 - DNA, 6676 bp, Homo sapiens
  repeat_region (1)..(6676): mer66i
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tctggtgaccacgaagggacgaagacggcaagtgagagagagtgagagagccgagatggcaatcggtggagagacaagatggtgagacagtggcgatgacggcaatcagtgatcagtggagaggcagcaakcggcgagagatggtgagatggtnatcaaaagctgcagagcaataaccctgaggctgtaacaananagagctgctaacaccgcagagctgtaacactaaccaaaggctcttttcagagccatcatttttcctggcgggcagcggagccgagcggacaggcaagtggccataatactgccgcctcgtgtgggacccgctgctctgaccggcaggccagtgggttaccggtccccgcgcttgcccctcncgctgtggcagctgagcccacccaagctgagggaacctggggaagaccttcacccgggtcccacgtggaagaccagtcagcaccattttggctcctgtggacgggtgagtgtcccctctgatcccmccccataatatcgggtaaactagagaataaaagcctttggctaggtggtcagttaaaagtcccccatcgtttgggtgccccgagacacatccttgtcaccccttcccctggtcctttctcttctgactccattttattgctccactagccattttattttcagtcctaaaatgtatgttttgtttgcagtcttatttttgcttttgactttctgttgactgtttgggcaattgtttaaggcaggacacttggttgtgagaggtcccccattgtgttgactctgggacgccagagtcacgttgttctgtgaccccaactaggcctttggggttcactgttggccaccccacagatgctccggggttttcggcatttggngaacccctggawactctggggtttctggcatttggtgtggggaccctcattggcttgatactcaggtactccgggttttcagcattcggtattgttggccgccccctggatgctccggggttttcggcattggcattcctttcaggactgtgggttagagtcccatcctaggggaatcttggtcttgccttttctcgttttctgccctaaagnttatnattttctgtaacagcattttcttttcctattgtcactttatttacacttttccttctacactttgcttaataaaaacmcttttttgtcgtatttcattcactggcaaatactcataatccgcttttataataccttgctacctatactttgacagaaagtgggaatctaaaaggaaaaagtaacaaaggcccagttgnttttgctctcgctagacttagaaaaacttctgtgtccwgtagagatccttactagacatggggacaacgatgagcatcccagaggactcgccactagggtgtcttttaggcaattggagcaaattcaaattcagcttagagaaaaagaaactcattttctattgcaacaccgtttgggtccaatacaaattggaaaaccaacagatttggcctaggcatggttctttacattataatgmtattttacaattagatttattctgtaaaaaggaaggaaaatgggaagaagtcccttatgtacaggcttttatggccctctaccaggatcctgacctaagggmtagctgtagaatgtgtggctcatgwtacttccaggcaccaggaagctacaccagatatgcctaaaggaccccctcctagctgctccccctagaacgcctacgccctcccttcggagcctcctcagtcccccagttctgagaggggtcctaccagttctctaatacaggattccaccccaaggtcatcaggcacccctcctccttatccaacaagccccggcctataccccccgctgcccaaggaagtaagcccaaccagtaccaccaggagtggggccccgtatcagcccctaaaatcaaacctgtgtccattgcgggaggtagctgatggaaataggagaacantcagagtatatgtgccwttttccatgtscgatttggctttatgcaaggaaaaatttggccagttttcggaggatccagggaagtttatagaggagtttgttaagttgaccatgtcctttgatttaacttgkcatgacttgcaaatattattatccgcttgctgtaccgtagaggaaaaacaaaggattctaggtactgcccatgaacatgcagatggagtggctgtgtgtaacccaggccatgccatttactgtgtgggaggagatgcagttccagatctanaccttaagtgggattaccagagaggttttcaagatcttgaatgcagaaatcatatactaacttgtttagtagaagtggaagaaaaagtgtgtggttaagccagttaattatgacaaggttagagaaataactcggggaaaagatgaaaatcccgctctgtttcagggccgtttggttgaggcactcaggaaatatactaatacagacccagactccccggaagggcgagctctcctgggtatgcattttattactcaatctgcccctgacattaggaggaagctacaaaaagcagcaatgggaccccaaacccctgtaagccaactcttaaacatggcctttgggtttacaacaatagggacagggcagagaagaggcgaaaacaaaagaaatagccaaaaagcgcaattgttagtggctgctttaggccccctgccgcctcagggttacccacctcgagaaaatgtcgtgagatcggcgtctaggatgcccaganaagagccccccactcnccagcccctgggccaaaatcagtgtgccttctgtaagcaagagggccactggaaawaggatttcctaaccgwccccagtgagmtcggaaagcwtcgcgtcaataccagagctaacctccttccgctagcccccagmgagctgccttgcccaagtaaatttactaagngtctgggctcttgacctaatggacagcctcccamagcggcatacaagtggccgcttnaacatttttcttcagtgtctccactgccgggtaggttctctggcgastcggggcctccgaggtctccccttgagcaatgcwgttcaccctgctcccttccttatktgatgctatgkgatcwtcttccctgcctcttcctgtcttccatacctactggkgcwaacaaaatttggccaggtaggtgggtcccaawtttgtaaataacttggatccagttgcctwgtatakgtcattttacttkgtgtgtttaagtstmtgtamaggttwaatgtgtgctgtntttagcaggctatcanattggctnagaawtaaaagagtgctcgtgaattaacacaagncnagtctagacttattcgtttgaaaaatgttacgtcttctaaaatttaactctaagatttttanctaggtaaatcactgatgtgcataggctttaaaatggttaaaatggccamwggtcgttaaattcgcatgggaccttggttcttggaggtggtctaaacatagctattaaaagtaaaaatgttaaacacatgtgaatggaatagatgcttaaatagtgagcttnttgtacggtttaaaatcttaaaattgtaaaatagttctcatctatagaatkccaatgtctggtgggcagttcaggatttcttgctccctagntttatataaaatgtgccaaagaaatgtattttttattgggaaaaaangttttcgtctaatttggaagttattaaaagggaggttcaaaatataaggaaaccantgngtagaaaagagagatataaagaatgttatggatagaaaatgtattttttgcaaagaatatataaaaaagagtaattttnnatnaagaggaatcttgtatagtaaattcttgtcctaaagtaaaatgaccggttatttaagaaagaggtagtataggacaagtaagaaankccaagcatgttgtagatggtctgtgtnagtcatgataaggttcatgaaggggaatttataaaaagaatttttgtgtatgattaagcttgctataattaaaagaaaattgtttacaatagactttctaaagaatggtctacgtttkaaaaccgaattttcttaaggtattaatttgntaaattaccagaaattttgtttttcaatnctgtaakctagttcttttgaaagcttctcagcganttcatgtaactctmtcctttagctttttcgtcagctcctgtgagttttttcctctagttctgttgttgtggcctgatgctaaagtgttttgtcttagaggtctgtgggagcagtgttttcccccagtatagtttctattgatataatcttatttttggcttttagtttttgactcttacattgcttagaagggttttaagggctaatgagtgcctgcccacctccattcccgtctggcctagaacgtttaattggctataagtcttttgactctaagtcccttggscaaaggaaattccaaagaaacttaaaaactaactcaggccatgacaggaaacagggggttagacatacctcactatgccccctttwmaatttaggctaggttcacaaggcccttcaagaatatggaaataaagtattgcctctcacaagacttagtcttactaaaaacttaaaaagaaggatcccctgaggatcaattacaaccaaaatggaagggccctatcgggtattgttaagtacccccactgctgttaaacttcagggaataactagttgggtacamctgtccaggattaaacctgtttcttatgagtcacaggcacaaaaggaggacaccatgacctacatctgtgaacctttggaagacttccactacctatttaaaagaatcaacactcagccagaagtggtaacgtgatgctgtgggtgggaataggagcattaatttttctcttcttcctgattgtaatacttcttttctatcgctttagccaaccaccttctcctgggaaacacctcttttgtccttgttgggtgtagaggccactctaaggcccaaccggataccatgctgtcactgttaatcctgtttgctctcccaattaccctgatccagtgtgggtgggaacaaaactctatagtaaatatttcaaaaattatagcatcagggaatcatcttcatggttgctggatttgtcatcaacatccccaggatagagagttccatcttctggcctatccggaaaatctcacagccatctccccagacctcctaactaaccatagcaatcccgaagtacccaaacccctacttgttaagtggaactctcccccacttaacggattccacctgaacntccccmaccactattacctggacctgggaagttgggtatctatatctccagtgcactaatgattctatcttttgcacccactgttgtgttaatgacacaaaagcggaagtttccctgcgatgctctgatccaactctagttgccaagttcccaaggccgcagcaaggtaaatgggattccacttgtaagcgaggagaccatatatggtgccttctcctggatcagaacatacaggggaaaaacaactgcctaatctgggaaggtgggagtaccgcccccttctggaaaacaaagattgttcgaccacccccattggaacaggggaagaatatctctatagacccaacttggcagcaaagaatagacatcacaccccgtagggcctccgtttgtgccccaactgggctcatttttgtttgtggccatgaatgggaagaagtcacacnccgtaaccactcccgactccccagggagccacctgttcttttaggagtagctttcccttgtatatcaaaaacttggaacagaggtgaatgtacgttggccacccttgcccctccaggggtcacagtctataaccccataagacccaggaacaccagaagtaaacgagcaataggattaattctggcgggaatcggggcagcaataggactagcagcaccctggggtggctttgcctaccacgagtcaaccctaaagaacttgactcaaaccctagaatccttagccaccaacacaggtcaggcactaaagagaattcaagagtccctagactctttggcaaatgtagttctcgataacagactagcattggattatttactagctgaacaaggtggagtctgtgcagttattaataaaacctgctgcacatatattaacaactctggacaggttgaggttaacattcaaaagatctatgagcaagctacctggttacatagatataaccagggcactgaccccaactatatctggtcgactatcaaaagtgccttcccaagtctcacctggtttttacctctcctaggacctttgatagctgtcttgttattactaatttttggcccttgcttgtttaacctcttagtaaagtttgtgtcttctagattacaacagttccaggtaaagacaatgctggcacaaggcttccaacccatcccgtctactgacccggagaatgaaagcgtcctgcctctgggccccttagatcaggtatccagagatttttactcctccggtgctaggcagggcctatgcccataaactcagcaggaagcagttacagaagatggacctccgcccttctgcagcccccttaagattaaggaggagtatctaatctctgaggggggaa

SEQ ID NO: 212 - DNA, 543 bp, Homo sapiens
  repeat_region (1)..(543): mer67a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgacaaagattctctccttgaccaaactctagccaggctcctctgagcccccttctccactaggcctcaacctcggcctataaagacttgaacaaacactaacatagtttctaatagctcaaggccacatccctaggatgaccctagcccccccttaaagtgcctgcctgagaaaactcaaggctgccaaaataatttactgtttgttccagccaacacctgaagatagggcccctgtctcccagtctctgtgggagggtaggagcctaacttcgataagcgccagttagcaaacacagatgggctaatcacattkacactgwccaaccttttgtaatttttcacttccctgactctactgagcccccacgcgtnccctctccccnctccctcattctccctttaaaacgcccagtcacctctgcacaaatcgaagctgagctcagttcacgctggactcttttccctactgcaatagtatattactgattaaaatccgtccttaccgctttaactagtgtccggctttgtttatctttgaca

SEQ ID NO: 213 - DNA, 661 bp, Homo sapiens
  repeat_region (1)..(661): mer67b
  misc_feature: n is a, c, t or g
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagaactgcagaactctcggcacagaacaactccatccaaacccctgcactaagagacttgaccaaactctagcatggcttctagcagcataaggccgcgtccctaggatgaccccagcccccccttaaagtgcctgcctgagaaagctcaacgctgccaggagaatttactgtttgttctagccaacacctgatgataggcccctgatctccctttcttagagcatttactaaaaagggcttacaattgtgaatccttcctctgtccctttgagatatgtatgtatctcctacaactcaggagtgtctttctcaaggacctgagagccattcctttgaaatgtaatcatcgagaaggatagggcctctgtctcccagtctctgtgggaggatagaatcctaactttgataancgccagctagcagacacagctggcctaatcacattgacactgaccagccctttgtaatttttcacttccctgactctgctgagcccccacgtnccctctccccnctccctcattctccctttaaaacgcccagtcacctctgcacaaattggaatggarctcagctctttcccctactgccagtagttactgaataaaatccgttttcaccgctttaactagtgtccggctttgtttatctttgaca

SEQ ID NO: 214 - DNA, 710 bp, Homo sapiens
  repeat_region (1)..(710): mer67c
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaagggcaaatacaaattaaaaataagaggcttnaattctccctggtgcgaaaagagaaagacaccctcctctcccttttcttagagcatttactttagaaaacttgtaattgtgaatcctttctctgtccctttgaaatgtatgtaaatctttttaaaagctaaataagcctcttgccagctttacgacccaggaatgtctttctcaaggacctgggagccatctctttgaaatgtaawcatcaaggaagatagtacccctatctcccagtttctgtgggagggtaggagcctaacttcagtgggcaccttgctccaagttgcaaaactacctcctgtcataaagatatgagaagtttatttttcctttggataaagccaattagctaacacagatggccaccccaattaccaggtgaatttaggatgaactatgtgtgacaaatggtgctgtcaagtcctcttacttgaggactagttattgtttatcttgagaacatgtatgtaatgggctgtatctgctcggctatataaaagggtgagatttctttctgtstttgcaatctcttagcagattgcctgtgatgcgcatcacattctggtttaatgcttattcaataataaaacgtgttttctttctcttctacctttgtggagaggttttctgggttgggagragattttgtttttaattatatttccccaaca

SEQ ID NO: 215 - DNA, 514 bp, Homo sapiens
  repeat_region (1)..(514): mer67d
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaccaagacagccttaacgttcccctcagcttgactraactttagacaggtttcttcctgactataggcccctgacctcccttttcttagagcatttactttagaaaacttgcaattgtaaattctttctctgcccctttgagatgtaaatcttctacaacccaggaatgtctttctcaaggacctgggagccatccctttgaaatataatcawggaaggacatagggtccctgtctcccagtctctgtggaagggtaggagcctaactttgataagnagcaattwgcaaacacagatggcctaatcacattgaccaacctccccaccaacgtcctccagtacttttccactagctcaccccagcgcttaaaaatccacctgccttttgtttcagnggagttgagttcaanctctaacccctattncaatagtctctgtcctttattgcaatagtcttgaatgaagtcttccttgcctgtttaacanntttccggtgcaatttttcttttaca

SEQ ID NO: 216 - DNA, 563 bp, Homo sapiens
  repeat_region (1)..(563): mer68a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgcagaaaagagttaacatagcaggcctgagactgctatccttagaaaggcctgcttgcaaggttggcccttggctggcatctgggaacttggatttcgggagggttcccaccattcccwkaactgataagagtggctcactgtgcctaaactgtttgtgcaaacaatatggtttatgctgaacacctgctttccttctgggagtctggaattttggtacgtgctaggcagagggtgcctacgtgaccagcccccartaaaaaccctgggcactgagtctctaatgagcttccctggtagacaacatttcacatgtgttgtcacaactcgttgctgggggaattaagcgtgtcctgtgtgactccactgggagaggactcttggaagcttgcgcctggtttcctccggacttcgccccatgcgccttttccctttgctgattttgctttgtatcctttcgctgtaataaatcatagccgtgagtatgactatatgctgagtcctgtgagtcctcctagcgaatcaccgaacctgggggtggtcttgggaacccctaacaca

SEQ ID NO: 217 - DNA, 568 bp, Homo sapiens
  repeat_region (1)..(568): mer68b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgcagaaaagagttaacatagcaggcctgagactgctatccttagaaaggcctgcttgcaaggttggcccttggctggcgtctgggaacttggcttttgagagggtccccaccgttcccttaactgataagagtggctcactgtgcctagactgtttgtgcaaacaatgtggtttatgctgaacacctgctttccttctgggagtctggaattttggtacatgctaggcagagkgtgcctacgtgaccagcccccaataaaaaccttgggcgctgagtctctaatgggcttccctggcagaaacattgcacacacgttgctgcattttattgctgagggaagtaagtgygttctgtgtgacycctctgggagaggacmywkggaagcctgcgcatggattcctccagactccgcctgatgtgtcttttccctttgctgatcttgccgtgtatccttacnrtgtcgctgtaataaatcttagccatgagtataactgtatgctgagtcccgtgagtccttctagcgaatcaccgaacgtgggggtggtcttgggaacccctaacaca

SEQ ID NO: 218 - DNA, 179 bp, Homo sapiens
  repeat_region (1)..(179): mer69a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ccagaggcagatttaccgtgaagctaatgaagcttaagcttcagggcccctcacttgcataggccccttccaaggccctgtacctaattttgtattcgtaattttgtattctttttcttaaagagggccccccaaattgtataagcttcaggccccacaaaacctggatctgcccctgg

SEQ ID NO: 219 - DNA, 1501 bp, Homo sapiens
  repeat_region (1)..(1501): mer69b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagaggcagatttaccgtgaagctaatgaagcttaagcttcagggcccctcacttgcacgggccccttccaaggccctgggaggggccctagcaatgtgttcacatggtcatatgtttttgtaaaatttgcaaaagtaagatattttaaccacaattggttaagactgctgtctctttccactccgacttcccctccatcacacttcccctcatgtcgggtggtattggagtggccgtgggcatttttgggatctggctaagggaaagttgagttggggatacatttagtttgggtttagtgggatatatttatgtggttcgcagtcacttccgtgtatagttaagttattgctagccgtcccggtataggaatggcttccaggaayattcctactgcccactgtgccgactcacccagcgtcgtgacmtgaggcacaggaccggagrtcgtatcgcgatatgaacgtgtcctacggcacctggcaccggaagtatgcgggtagtggaggagaaacaaggtttgaaatgtacagagccagaagctagtctgtggaaaattcttccaatcatcagacgtgtaaaattgtaagcggaggattcggttctcatcgatgcctagycagagcagaagttctctcctgtcagaaatatactcgataatgcagcgtatacaattataaatgcamcatgcatttatttgcatttttggaagggaatcatgcgaaatagaatttatcagaantccttgtttgtagggcacagatctrtagcagtactacaaacagtgagcacatctgtnnnnnnnnnnnnnnnnnttattaamtttcttgctgatatgacatgaaatwctgacgttaacgaagataacasttcacttctaatttaccatgacaaaaaagacatcagtgacaaactggttactgagtgtcattaattctaagagyatttaagattagtcactgcacaagaaaacttgaaatgccctgaaatcttacagctcatatatgaaagaaacttgataggggtttccccaaatttgacaacaattctaaaaatttacatgacattaccaataacgagttgtgaagctgaaagaaacttttctaaactatcaataataaaaaacaaatttcgatcaaccatgctagaggaaagactgaattatctttctattctctctatagaaaatattacaaaatcgttgtcatatgaagaggcgatcaaagagtatgcagccaaaaaatgtagggaaaaartattatagaagtgtgtcaggcagttaattaataaaaatatggtgttgtttttctggattttgtgatgtttgtggtatttgtcaactttttaaaatttgtaatttgttgcgatttcttttctcattctaaataaatattcacttttgtacctaattttgtattcgtaattttgtattctttttcttaaagagggccccccaaattgtataagcttcaggccccacaaaacctggatctgcccctg

SEQ ID NO: 220 - DNA, 597 bp, Homo sapiens
  repeat_region (1)..(597): mer70a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aagcagattcgctaattaccagtcccaagagaagactcctactgcgtggagaatagcgaagatcatcactatgccaaccaccaggaacttcttcccggnccactgcatcytgrgctacwgtttatgtccwccatgcactggtnacctcgcttacccgantccggtgagacagaacgcgcgcacacacaagttacgcgaagcgggtttattacttacagacaggcagcaagggacaacagaagcctaggattcagggtragyymgtcycccaaggctcaggaaagctgcccagggcggatggaatcttgwctgcgcgtgccccacttgcactgcagctgagggrccccggaaggcaccccgccctgggttttatacctcaggaacmacatgacacgctgggctaaagcgttgaaggacatcctgtttcyaggagaganwggaacagagcccaggctgttcnggccagttcctccctatctcaggatgttgcattcccagcacattctacagttattcttgagaactacaagcaagaaagaggggagwactgggtcggtccaaggccacctggrgaactgtcctgcagagctatccgag

SEQ ID NO: 221 - DNA, 665 bp, Homo sapiens
  repeat_region (1)..(665): mer70b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aagcagattcgctaattaccagtcccaagagaagactcctactgcgtggagaatagcgaagatcatcactatgccaaccaccaggaacttcttcccggnccactgcatcytgrgctacwgtttatgtccwccatgcactggtnacctcgcttacccgantccggtgagacagaacgcgcgcacacacaagttacgcgaagcgggtttattacttacagacaggcagcaagggacaacagaagcctaggattcagggtragyymgtcycccaaggctcaggaaagctgcccagggcggatggaatcttgwctgcgcgtgccccacttgcactgcagctgagggrccccggaaggcaccccgccctgggttttatacctcaggaacmacatgacacgctgggctaaagcgttgaaggacatcctgtttcyaggagaganwggaacagagcccaggctgttcnggccagttcctccctaamtcaagatrttacattccctaggagggkcaagaacaaggccaasctgttccgggcagttcctccctatctcaggatgttgcattcccagcacattctacagttattcttgagaactacaagcaagaaagaggggagwactgggtcggtccaaggccacctggrgaactgtcctgcagagctatccgag

SEQ ID NO: 222 - DNA, 711 bp, Homo sapiens
  repeat_region (1)..(711): mer72
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
atgaagacagcgtwctcttnngnattancatgataaataaaaatraaatcctaaracccccaaccgactgarcagaccacctcttggccgaggggaccccagagwaaccttgaaarctgagttcycggccgkgacgggatggagggrtcagacacacctcgttrtacccctcccttrctaaccatsaykrggcttgcytccctaargrctaaacagaaaccagcyctttcgaaagactccagcactgrnnnnnnntcctttccttcctgrtaagagaccaccraccacggagwgkttctggccagtctncggaggatgtrcagcgagggttttcgtgtcctctgcttcaccttttgacgtcagagggccgaaaactccaccctcngatcatgctaacactgccaktttttgwacatgggwcccatgaagaggcaggaarctcaattgtgcacgcgtgtgtttctccyttcacgnatattcatgactcctcctatagcttattgaatatgtatatttggccatyccactcagcataaattcctgttccctttgccyctccctcgaaatgtctgtttctggcttctggccggaggctacgcttcccagcctgtcagaatggccgccctgcaggctgcaaccctttatgagaaataaagctctcctttccaaatttgaacctcntcattcttcagttgacaaagtrkcaaarat

SEQ ID NO: 223 - DNA, 636 bp, Homo sapiens
  repeat_region (1)..(636): mer73
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtcataaatttgtttaatacagttgctgcctcggcatccatttttaggcctgacataagttgtttgaaacccagtcgtaccccgtcacctttggcctagttaaaacntctcctccctgtgtggttgtttgcgatatggcccacttgttcctcatctcgctgacccaaaacccaacacaccccacagctgctgaccatgataaaacctaatggtcaacgccagagtcatgtaaataagtttcctccttctggcatgttttctttaaactagccaatccacaacccccgtnggaaagcctgagggataatgcccatggaccttaataaaggcatactcccgcagctgctctctccctccctacccactggttgagctccctgccgcctccagacttcccatcggcctcccgtcggcacccctaacctctctgggatctgtaagtaatamatttcttctgtttcatgcattttngtttcacttgcctcactgtgtctcmcctgacacacacactcgaacctaactttcccccgggtcagggctctcctagaaaatggctatcttggcttatggccactctcaagagagagacctcaagaccaaattagaaagaaancataacgataaaaatcacaaca

SEQ ID NO: 224 - DNA, 624 bp, Homo sapiens
  repeat_region (1)..(624): mer74
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttttaaaatgtaggttttattatttaggtatgttraggccaacagatcaggagacgactgccattgaaaagacagtttgttattctcacagatcccaagagaagggggcatgccgcgccacggggagccccacggggaagcaccggggtcggtcaggaggcagaaggagcgacgggaaaacgtrggcaagagcctttattgtggtttccatgggaaggaatgrgcgaggcagggtaagcaggcttaggattggctagtttgaataatttcagcaggctctggggyataggggytgtccctagttgcctggtncctggccctgggatgattagggcagggggatagtggcccagagtgtaagagccaaatagaggaggtggttgggggtatgggctctggattggttggtttgcatatgaaaggcgcgctcccgggcgagtccttcgctatctctaagaattggctagccctgggaggggcagtctctccgggrtcagcaaggccccaagatgtcaaarcatyataaaatacagaaaataaaaaagcatgattaatacaakytgctctgtgatgaacggatgccaaatagwcgaatacagaatctaagaaaacacagaacaca

SEQ ID NO: 225 - DNA, 558 bp, Homo sapiens
  repeat_region (1)..(558): mer74a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtattaaccatgttttttattttctgtattcttgatgctttgacatctggggccttgctgaccctggagggactgcccctcccagggctagccaattcctagagatagcaaacgactcgcctgggagcgcgcctttcatatgcaaaccaaccaatccagagcccacacccccaaccacctcctttatcgggctctcacactctgggccactatccccctgccctaatcaccccagggccaggtaccagacaactagggacagcccctataccccagagcccgctgaaattattcaaactagccaatcctaagcctgcttaccctgccttgcccattccttcccatggaaaccacaataaaggctcttgcccacgttttcccgtcgctccctctgcctcctgaccgaccctggtgcttccccgtgtggccccccgtggcgtggcgtgcccccttctcttgggawctgtgagtaacaaactatcttttcaatggcagtcgtctcctgatctgttggccttaccatacctgaataataataaaacctacattttaaaaca

SEQ ID NO: 226 - DNA, 622 bp, Homo sapiens
  repeat_region (1)..(622): mer74b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttttcttagattctgtattcgtctatttggcatccgttcatcacagagncanttatattaaccatgttttttattttctgtattcttgatgctttgacatcttggggccttgctgaccccggagagactgcccctcccagggctagccaattcctagagatagcaaaggactcgcctgggagcgcgcctttcatatgcaaaccaaccaatccaaagcccatacccccaaccacctcctttatcgggctctcacactccaggccaatattccccctgccctaaatcaccccagggccaggtaccaggcaactagagaccacccctgtaccccagagcccgccagaattattcaaactagccaatcctaagcctgcttaccctgccttgcccgttccttcccgtggaaaccmcaataaaggctctggcccacgttttcccgtcgctccttctgcctcctgaccgaccctggtgcttccccgtggggctctgcgtggcgtggcgtgcccccttctcttgggaactgtgagaataacaaactatcttttcaatggcagtcgtctcctgatctgttggccttaccatacctsaataaaataaaatcccaggtacattttaaaaca

SEQ ID NO: 227 - DNA, 514 bp, Homo sapiens
  repeat_region (1)..(514): mer75
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cccttttcccgtttgccccgagaatactcgccggcggcgcttgcggctgcagcgtttaccccgagataactttgccatgaaatatnttgcttttattattattttcgcatcgttctagtatatcgactttggaaacaaaagacatcgttctatttatagcattctgtttttagtagtggtatttccatttacaaaatatagtaattctcgattgctgaaaatgtcaaatcctagaaaacgtagcattcctacacgtgatgttaacatcgttctcgaacagttgttggccgaagattcatttgatgaatccgatttttccgaaatagacgattctggtgattcagatgattctgatgttagttctgtttagaaataactccaagaacagtttttatattttattttcacattgaaaatcagtcagatttgcttcagcctcaaagagcgtgtttatgtaaaattaaatgagcgctggcagcgagctgcacttttttttttctaaacgggaaaaggg

SEQ ID NO: 228 - DNA, 688 bp, Homo sapiens
  repeat_region (1)..(688): mer76
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaggagtccagctcctggcyaaaaacctacgtgtgatttttcaggcctgaccataggcaattacaaaggctttacctggcaggcctcatgggggaaagctgccctccccacaccagacttggtgcacagccagtgcattgcagtctctgaagggagttgcagtcaaggactcaggcccccctggccggccacgctcttacacatatctgcattcctagcccaggcgcctccgttcggaggcctctttattcggggccttctgcagaggtcttcctcaggcgcctctgccgagacctctttatgaggggtggaagcgggagccttgaagacatttntctccactctgactcagtactcagtgcttttccactcctatcccttccctntcctcncctccatgacccacgggtccataaaactgcaggagccttttgttcagggctccctcaacagtgagatgacccccatgtctgtgccgatccacctgacccttgaccggtgccatttccatgnggaaaaatggaacatggggagtcggtactttctctggttttagcctcttgcttatactatcgaagkaagtgattaaagatttgactgttactttcattttggcttgttgccttaatcggctnctctgacacccggcagctcagctctctctccagctcagctgagctcctgaca

SEQ ID NO: 229 - DNA, 650 bp, Homo sapiens
  repeat_region (1)..(650): mer77
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
actacggggggaggtgtcaaattcaaaggtctccaagacmaccctcctgtttartgattcgctagaaggactcacagaactcagaaaagccgttatactcacagttacggtttattacagtgaaaggatacagattaaagtcagcaaagggraaaggcacataggncagngtccaagagarmcaggcacgrgcttccagttgtcctctcccggcggagtcgtrcgggcagcgcttaattctcccagcaacgrtgtgtgacagcacgcatgaagtattgccaaccagggaagctcacccgagccttggtgtccagagtttttrttgggggtcggtnanataggcatggntgaccccgcagcatggctgaccttggtcttctcaggcttgagccncccaagcatggctgacctnagttactcagtctycagcccctccagargtcarryaccgtgtagcctaaggcccccaccataaatcacattgttagcatrractgtccggtatggcccaaggccytcgcagataaacaaagayactyttatcaggcaggacattccaagggcttagaggttatctcccarrgcctgaggataamcgagggccaganctttctttgggcaaggttaatcctttactgyayaagaccaca

SEQ ID NO: 230 - DNA, 239 bp, Homo sapiens
  repeat_region (1)..(239): mer8
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagttgtccctctgtatanncgggggattggttccaggacccytgtgtatacmaaaatccgcgcatactcaagtcccgaagtcggccctgcggaacccacgnatatgaaaagtcggccctccatatatacgggtttcgcatcccgcgaatactgtattttcaatccgcgtttgattgaaaaaaatccgcgtataagtggacccacgcagttcaaacccgtgttgttcaagggtcaactg

SEQ ID NO: 231 - DNA, 508 bp, Homo sapiens
  repeat_region (1)..(508): mer80
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggggttcttaaccttttttgtgccatgggcccctttggcagtctggtgaagcctatggaccccttctcagaataatgtttttaaatgcataaaataaaatacataggattacaaaggaaaccaattatattgaaatacagttatcaaaatattaaaaaaccaaatttgtgatatagtaatatatgtgcttctttattaatgcattaaataacaagatctagcggcgggtctaataactaccgtaatttcgaagtagtgatgagcataaatgatattttgagatatctgcaacaactgtaatgtgatatgaaaatatctgtgatttctattggtgacaaagtcacaggtactgctaatactactgtggtttgttgcctacattcataattgaaggaaatgctaaatttcagttagaggttagtgaaaataaagatgtaanttttttccccatccaagttcacggaccccctgaattctatccatagactccaggttaagaacccctg

SEQ ID NO: 232 - DNA, 114 bp, Homo sapiens
  repeat_region (1)..(114): mer81
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tagggtgaccaaccgtcccggtttgcccgggactgaggggtttcccaggacgtgggactttcagtgctaaaaccgggaaagtcccgggcaaaccaggacgagttggtcacccta

SEQ ID NO: 233 - DNA, 653 bp, Homo sapiens
  repeat_region (1)..(653): mer82
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagttgatcctcattatccacagtagttatgttctataaagtcaccgcgagcactgaattagcgaatactgaaccatcgctcctagaggaaatacagagttaggttcctgcaagcctctggtcacaacattttcatcaaccgatcaatatataacyttgttttatgtgtgtttctgtttaaagacnncttatttaatatatattgttgatttattaacactgaactcacagccaacagcactataactcatgcctgaatgaagcttatctaacacacatattttctccataaggtacatcacagccttcttgtgcttaggaacaccagacagcacttcagcactatgctcggggccattttaaacggcgaaatcaccaacaaaaagcacaaaaatgtgaaaaacgtggcactaaatagacctcgaaaaggacgcttgtttacggtatgagagctgaaacaagaaggcagagcgtcgccttgttcgacctcagctgggaacgtgcacgtcgggcgactcgaatttttcgctgctctgcgcatgtntgcaaatgaccgngaaagtgctncaagtattgattttggggttacaaataaattttagcgagtaggcgaattcgcaaatacggaatccgtggataatgaggattgactg

SEQ ID NO: 234 - DNA, 441 bp, Homo sapiens
  repeat_region (1)..(441): mer83
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggagtcctaattagggaaaaggagtcaggctggcgggaccaggggaaagcaaagggagaaagcaaataagctataagtctgcctttcttcatggtccaggacacatagccctcctgcgcaaataactcacaatcttcctgcgcccaactattatcaaacacctcagctgacagaaaaatgcaagttagctcmctgcaaccttggcattatcagtactgcacgcagcmctctgcagcccaagaaccatcctataaaatctccagcaagcctttgtctccttgcagtcagctcctctcttgctggtctgcctgttgcttccttgcaacatattttcatactttctctaataaatctgcctttctttacctacaactgtcttggtaaattatttttacctcccgcgccaccggccccagatagtcgccgctccccacgrca

SEQ ID NO: 235 - DNA, 378 bp, Homo sapiens
  repeat_region (1)..(378): mer83b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggagtcctgataagtaagcaacaatgaggaaggggccccaggtgggggagggccccaggtggggaagaacaatgaacaattgttctgagagacggctaatcacaaacaacccgcgggcacaacgacctcgttccgcatgtagccccagcagcatgacctcattctgcacgtagccccctccagcacgaccctataaaacttccctccagcccctgcctctttgcagacagccccttctctgctgtgctgcccgttgcaaccttgcaacgtattttcatactttctctaataaatctgcctttctttacctacaactgtcttggtaaattcctttaccgcctgcgacactggccccagatagttgcacccgtgaca

SEQ ID NO: 236 - DNA, 373 bp, Homo sapiens
  repeat_region (1)..(373): mer83c
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggagtcctgataagataagtaagcaacaatgaggaaggggccccaggtgggggagaacaattgttctgagagacggctaatcacagacaacccgctggcacaacatcctgttcccaaatacctcgctccgcatgtagccccagcagcacgacctcattctgcacgtagccccctccagtacaaccctataaaacttccctccagcccctgcctctttgcagacagccccttctctgctgtgctgcccattgcacccttgcaacgtatctttgtactttctctaataaatctgcctttctttacctatgactgtcttggtaaattcttttactgtccgcgatgccggccccagccagtcgcacccgcgaca

SEQ ID NO: 237 - DNA, 508 bp, Homo sapiens
  repeat_region (1)..(508): mer84
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaggagagcaaagaccacctggtgaccatcaaacaggccatccggaggcaaaactccttatctggggaatttagaagtaattagacttccctattatctaaagcaggcatctggttccaggcctctttcccnnaaaaacttataagtaactagaatttctatacgtctccggaatgcatgcatgctgaaactcactgtgcaacccttgctgacatcaaggcaccaaaatgtctacaaatgtaatcatttaccatgacctacgtggctaatatggtccaaattacccttaagctcccgctttaaggtccataaatgctcctaaggaaaaatccaccgcggcgcgctcagtcctctcttgctgaggcgccccgctgcactctkctgcagcgttctttctgtctaataaaactttcctttttcaaacctatactgttgtcggtaaattctttttaccaacccacgagtcgaccacttcccgatgccggggctctgacacctcgcctggca

SEQ ID NO: 238 - DNA, 140 bp, Homo sapiens
  repeat_region (1)..(140): mer85
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cccatttatgcctgaggttgcaattttttgaatttttgcatgagtgaaaaatcagaccttggcgatgaccttgagcagtaggatataaataactcccacatgcttagcgttccaataatggaacactaggcataaatggg

SEQ ID NO: 239 - DNA, 206 bp, Homo sapiens
  repeat_region (1)..(206): mer86
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gacttccgtttctagtaatatggtagactagatatcctgaaaacccttccgctacaaaacacctagaaatgctggataaaatataacaaacatccttttaaatgcatagctgagctcgcaagaaagtaagggaaatccccaggggccaaaaatgaagagagaactgaaaaccagagcggtgagtamgtgagctgacgctgtggctg

SEQ ID NO: 240 - DNA, 541 bp, Homo sapiens
  repeat_region (1)..(541): mer87
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaacagtggagggagacctagcatgactgactccatcttgcctctgacccccwgsggtawcatcctttaggctaaaagcttctgcttaktcctgcacgtaggccaagctaactatgggaggaatttagtttatagttcaactttaaaaaagatggtaacagtccctttcccaaactaacccccgaggagataaggaaagtatacacacaaataacaatgttatgttaaagatttataggaacattgtgacctgacctaggacaaagaagttttgmcaactcctcggactcttgctggcgcccagatgtctgtggtcatcggtcacctcctaaccccaataccccncttsttccccttcccctagcataaaaagaagcctaagattyatgctnatttgagatggttctttaggacgctagtctgccatcttctcggtttgctggctctccgaataaagtcactttccttgccacaacacctcgtctcttgacttactggctgtcgwgcggtgagcagtaccagctttggattcagttaca

SEQ ID NO: 241 - DNA, 612 bp, Homo sapiens
  repeat_region (1)..(612): ltr36
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaaccaagtacccccatttttctaagaaaaagagaatgagttttattatttttttttctyttttctcctttttcccctgttccccacttcctacttagccctttagaaatgcaattataaccttttacctccccttcaccagacactccctacagggcaagttcatctaactatgtgcttagaagctccagagcggaactctctcccaccaggagattgcctcgagagataacagtcratttacaacccaaagtatgcccgctacgaaactctctcccacctggagagttttggccacytttacaacctagttctgcccacgaaggcgccagcagtcaccagctcaaccgcctggtagataaggcaccgaagcaagtcacgtagacccccacctgctgcttcctcccctgcatgccattcatgccaagcccccttttaaaagyscctgctttctgctccaaaagcgaagcggtacccttaaggcaggaagcctgtacttcttccccctaagctagctttggaataaaaagtcactttctttataccagacctcgctcttgttaattggactctgcaagcggtgagcaactgaacctgcgtttcagttaca

SEQ ID NO: 242 - DNA, 426 bp, Homo sapiens
  repeat_region (1)..(426): ltr37a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtagggaaaaattgtgcttcaatggaaaactatgcattgtctagagcacacccttccgggttatctgattctagctctgtcattgtctttgagctattttacaactctgtaarttgtagataactgatagcaatgcaaaataattcttgtctataganatgcaaataaattntgtccggtrgaggttcaattgacttccttcccccactgtggaaaaagccagttttgcntcyatttgcaaattcatttcaatattcctgattncctataaatgtgtstgttctttgaattctcctttgaaccggttrtaacatcttactggttccctcattaattaatgagttaaataaaatctttaacacgtgttcattttatatytgtatgagagtcatgattttaccttttttgaaaattatcctttaaca

SEQ ID NO: 243 - DNA, 468 bp, Homo sapiens
  repeat_region (1)..(458): ltr37b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttaaagaaaaattatccmaaacttggaaataaggcaaaaagatgacwgcatgtcctttcaatgtcatactggagcattgtctaataggctcactcaaggattatttaattatctaggggaatgtacctntgttgactttgctatttactatttgattagggcccagatactatgaagttacatgttaacttgtagatttctgtccagtagaaaagataaccycaaaggttatagttttattgccctgtaggatattaaccagttttgtatctaacttagcaatcttattccarcattcttctttactgaatgcctataaatacctagtttctcaaatgctctttgaaccagttttaccatcttactggttccctcattaatgagttaaataaaatctttgacacgtgttcattctatatttgtatgagagtcatgtttttaactttttgaaaattatactttgaca

SEQ ID NO: 244 - DNA, 556 bp, Homo sapiens
  repeat_region (1)..(556): ltr38
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaaccgagtatcccagcctcaaaatgcattttaaaacttttttctttttcttttttgctttcagccttgaaacatactttgaaactctttgtttctccctttcccaccaggcacttccgtgaacagtgctcgcttatctaattatgtgcttgcttagaaattccaggggccaattttgaaacaaaccaggcagagagacccagctgcagaatcctcccgcttagggggagttatgaacagttagcccaccactaccgggctgaagtcaggatgatgcaaaccagacctccagacgggcgattactcaagatagccatcggaacaagacatgcagacctccaccctcctgcaccactcccacatatttcccacaccttttccttcttaaaccccttcactcagcccaaaagtctgaaatgtcttctttgaggcatgagcctggccatctcccatctgctagcatttgattaataaagctgctttcctttcaccacacctcgcttctcatgttttgagcttctgagcagcgagcagctggacttgagccagttaca

SEQ ID NO: 245 - DNA, 610 bp, Homo sapiens
  repeat_region (1)..(610): ltr38b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaaccaggcagcttarcttcaaaatgcattttaaaacttttttttccctttctcttgagtttcaagatataaccttgaagcaaactgcagaagccttttctcttatccttaaaatagactccanatccctccctttctcaccgtatatactcccttcacatttatctaactgtatgctagtatctaattatgtgcttacttagaagttccaggggctaatcttgagacagacagaccaagcctggagacccagctgcaaaattccagagattacytcaaggcagctagtcaacaaccyrgccattgttgagatgaygccagcccacastccaggtggactgggacccaagatagccaccggaaaaagacacacagacnttgtactcagcacaattcttgcmagcacantkngnaatgcctyccwtatcaagttttccctttttaaacccttgccttcyccctaaaarttgaagyggttgctttggataggaatcyggccrcttccccattactagttttggttaataaagtcactttctttctacyagacctcactcttgtcaattggactctgyaagcagyragcagccdgacccatgtcakttaca

SEQ ID NO: 246 - DNA, 794 bp, Homo sapiens
  repeat_region (1)..(794): ltr39
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagacggagcagggaccccctcttaggggcctgcngggcactccccccccaagcatggaaataaaggaaaatcttgagttccttcaagggaaattccaggcacctagctagccctgagaagtaaatgagcaacttgataagcaagaaggtaatagtagcttaaaacaatagccaaggaagttagagtcacgrgatgtttggttcccctatagaaactaaagataacatcttaacatatgtccctgagttgtttttcagaaacccggacccccaccaaatggaaaatgccatccgctggcacgtagacctcagataagggggaactgaggactgaactctgaccaccgttctttgttctaaatttcttcctgaggggcctggaggaagtcacgcccacgagccagagctaacattcttttctgctgaccccaaatttttagacaaagcttcgcttccttaaccaatcgcaaatcagaaaatctttgaatcyacctatgacctgtaagcccccgcttcaagatatcccgccyttttaggccaaaaccaatgtrtaacctccatgtattgatttacgattttgcctgtaacttctgctttcctgaaatttacccctgcctttaaaaacccttacctgtaagccatcggggaggtcgggtcttaagcgtkagctgcccgattctccttgcttggcgccctgcaaataaacgccttmctttctcccgctgcaaaatctcggtgtsgatgtttggttttactgcgccgggcgagcggaccccagttcggttcggtaaca

SEQ ID NO: 247 - DNA, 588 bp, Homo sapiens
  repeat_region (1)..(588): ltr4
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gaagcaggaaatataaaaggaaaaacaagtaaagggaaaacaagtcctttcctgaccagtctgactcactccaaagtcctgctggagctatgataattatctgcaaggccaggcaggggctccgaaggagggctccaggagcagggatgagaaaaacaagttctccttatcagtttccctgtttgaaattctctccccataacattattctttgttctgctctcacaactatttttgtaactatttctgcaagtctgtaaagattttgtaagttcttgtttttctttctgtagcatggcaaggtcacaagacatgtttaagtaaggtaggctcatgttgcaaatcctgttgtaaaacctgtcacggtatgattaactgcctttgttctgcttctgtaagactgctttctcacctcgcaggttttgcgccaaaaacccgacttgcccctgcctgatgcatgtataaaagtcaagcccgtctttgttccgggctcagcctttggatgttaatccgctgggccagtggccacctaaataaaaccttcctgttgcacccagtgatctctccggcctcctgatacccacaaca

SEQ ID NO: 248 - DNA, 519 bp, Homo sapiens
  repeat_region (1)..(519): ltr40a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttgggagacaattctccatgggtctctcgcatttctgcacgtcttgtgagcagaggcactgactgcctttgttctggactatcttttcaaggatgtttgtatagcgaacagccttggaagatagagatagtgtctccctctggagcaaagggcaggtttgcttactagccttgnaarataaagataatgtctccctccggggcaaagggcaggcatgcttactgcccattataaaagattngggtttcctaagctcggggttcctcwsctgtracgcaaacccactgcgtgtgcagnantcatctggsccccttcgcatcgccctcgtgggacttgggggncaaggggaactgacgcaaacatgatgctcatgctgcctgctgtgctgtgartaataaagtcctttgtctctgacccaggagtctcgtgtcttctgccagcatccatgaaactgtggcaggctaacttgttagcttgcaagtagggtaaaatctcagacccttcacagttcttgaca

SEQ ID NO: 249 - DNA, 462 bp, Homo sapiens
  repeat_region (1)..(462): ltr40b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttgggagacaattctccatgggtctctcgcgtttctgcacgtcttgcgagcagagcactgactgcctttttttctggactatcttttcaaggatgtttgtatagcgaacaaccttggaagatagagataatgtctccctctggagcaaagggcaggcttgcttactgcccattataaaagattcgggttccctaagctcagggttcctctcctgtaacgcaacccactgcgtgcgcagcatccayctgggcctctycgcgtcgcccctgtgggamttggggggcaaggggaactgacgcaaatgctgatgctcwtgctgcctgctgtgctgtgagtaataaagtcctttgtctctgacccaggagtctcatgtcttctgccagcatccatgaaactgtggcaggctaacttgttagcttgcaagtagggtaaaatctcagacccttcacagttcttgaca

SEQ ID NO: 250 - DNA, 773 bp, Homo sapiens
  repeat_region (1)..(773): ltr41
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgccagttatcaatttattgcctctcagctccaaattcacccttattgcctgctctgtgaaaatggatctggaccctttaaatatttttcctttgccagctggcatgatgttaagctttgtcagtagagggcactggagagacattgcaggaggaaggggcttttcttcctggttcctgtgtgctgntgtgctwggcatgctcacttggcaggttcctgtagctcaggcytacagcttctccagtgcccagttcctgcagcgcacacagcttctctagcacccggttcctgcagcatgtgcmccttctcaagcatgcagctctggcagtntaatcagcagtgtccagcagcttcccccagcacccatcactcaggnggtttcacagtggggtgcctntggtgagatacctccctgtgaacagctttccctgacaccctagaggntggatttccnagaagttccacagggtrgatttccagcaagttctgttagtgcagtaccacagtaacttctctgccatccagtaagccatagctgtgcctttgtccaacaagatctggatctcagccctggggggaaggttctctcctgggtgctctrtctcagccctaggggtagtggctgctccttatatctgctattcctatattctttagagttctctttacctcttastagttaattccctgttatagttaatatttatattaaacttttcctgttcaaattactgtgtggtttctstctcctgattggacccagacatatag

SEQ ID NO: 251 - DNA, 495 bp, Homo sapiens
  repeat_region (1)..(495): ltr42
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtagggtcccccagnctttcccctcctttctttctctgtcctgaccgaaaaacagantgccttgaccactctgtgacccagccagctgcaggtttttccctgcaggcttgaacccaagccagggccttgaacattcccaggcactgataaaggtatttaggttgttgcccaaaacactgaaagaaactagccccggccctgagccaaattccttaaaccctcatataaactccataccctgaccccctcgctgcagacatacctaggtagaacatcccttttctctcactgtccatcttgaggactgctgcagcccactctgtaggtaagttcccctaataaatgctttggactgatcaccctggcatttagtgcttctttctttggaatcccaactggccccatctcagganggtttggggyactcccttgtgggaactcccctgccactgcttttggggcgactccagccacaggttcagcgggatraaaca

SEQ ID NO: 252 - DNA, 602 bp, Homo sapiens
  repeat_region (1)..(602): ltr43
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaggcaggataggtagtcaaggaagtaaccatgtccttgggacgcagcaaccgtggtgaccatacagtcaacacaataagccccagcattcgcattgtagtcgagctcattcaagcaaagctatcttcagtagggamtttcccctgtagagagcatgcgcattttgattttacctgtcctcaaactgaccctttgctcattataatagtaaaaaacacaacccctgggtggagatttaagatgctaatgagacatgcgatgtatgaacaagcatgtacagctactgcgcatgtgcacccagaggaccacccagaacatgcttactagtaacacctctttcccacctccttatgaataatcatgtaagactcccataaagggagtctcccyagcgccartcwwtgctgtctcatccttatgagcagcccgccctgaattctctctctcagggtgtactgtctattctgcacctaactttcaaaatattctttttcytttgcaataaattrctctatgctgcatctcctttgctgtgtgtctcttgtttaaattcttttaaactaagaagacaagaaccgaggtmtcacaacagccatcaaca

SEQ ID NO: 253 - DNA, 519 bp, Homo sapiens
  repeat_region (1)..(519): ltr44
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgataacctacargtcacatttggcaggcttccaaattaacccacctcagggaggtcttgtgattcatggccacatcctgtccctgagtaaagaatcttgtgagttcctcaaattttatcgtgagttcctcaaattgttgacgtactgattaatatgtaacctactgacattgaaaaggacactgatttgtttctgaatcataaagttttgctgatttatttntgaatcataaagttttactgattgttttacatatagacattttagcctgtatgttgcaatctgtagccaatgattataacctctgtattgtaccctccaatraaaaaagacaactccgatatgaggagttcccctcccttctcctaaactttcttataaaagccttccaacttgtaamagacttcggaacacwcccaactttgttggtgtgtcttcccaggtcaatcctcacatttggcttccaataaacctttatcaaattatttctgcctcaacagccttaatttcggtcgaca

SEQ ID NO: 254 - DNA, 525 bp, Homo sapiens
  repeat_region (1)..(525): ltr45
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaaccgcgggaccagcccaaactgggcctactctgttgataacaaaatgtcaagttaccttgtaggtataacagagcccaaaactgcaagtcatgtagcccgggcatgtgcaatagaaaaagctttgacctctaacaacacccagaaccaatgattcctcccctcggaaccaagaagaccgggacatgaccggaacctgaatgccggaactctttcagaagcaaaggggtccgttggcccggaagatctggggctaaaatctgcctcaacataccttaccgtaaatggtcaaatttgaagccctccaatcagaccctgccaagccaacattcctaaatcctttcccttgccctctgatcccttaaaacttgccccagaccccaaatcggggagacagatttgagcccacctcctgtctccttgctggccggttttgcaataaagcctttcttttctcaaaagctggtgccatagttattggcttctgtgtgcatcaggcagcaagcccatttgctcgataaca

SEQ ID NO: 255 - DNA, 489 bp, Homo sapiens
  repeat_region (1)..(489): ltr45b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgtaaccacaccagaccaatctggttcaacttttatgtaacaaagttgtgagttgtttttcagttgccatggacccccaggttgaaggtcatgtaacctgagcatgcccagatgaaccaagygtgcaaccacagggggaacctaagtgctcagaccgaggagtggggactgaattaagaagtggacaccacatggcaggatccaggatccaatcagattgagccctggcatcaccccatggcaggatccaatcagatcatgcctcccagcatcaccctcattgcaagatccaatcagatcacacctcattaccctatgcctataaaacctgccccagaccccagctcagggagacagatttgagcatttcctcctgtctccttgctagtcgacnnacttgcaataaagcttttcttttctcaaaagctggtgccatagtattggcttcgcatcaggcagcagnnagcccattgattgcttrgtaaca

SEQ ID NO: 256 - DNA, 461 bp, Homo sapiens
  repeat_region (1)..(461): ltr46
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttagtccaaactgcaccattttgtaagctccctgctattttgcagaccttggtcaaagtgaaacattccatgggggttcrggccgtgagaaacatcctgcctaaccacctgacnacaaggcggacaaaggcccactgaagaaacatccctatcatatcntgctgggcaaagatccaaggaacaccacgatcacatyctnctggaanaagggccagaactgcctcatcataggaacatcttatcaatatcctgccgggcagcaagccatactgcccagacccctcccacccagacctataaattgccccagcctgtaagcagtggtgggctctggcattaagctggtcccccacytyyrcaggttttntgctggatataaaacctgcatttgctgtagagctgccctctctctctctctgtgtctttctttaaccctcaccttcccttcaaaacctaaca

SEQ ID NO: 257 - DNA, 452 bp, Homo sapiens
  repeat_region (1)..(452): ltr47a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggaggctaaagcaactccatcttggatgctaatccaccatgttgacttctgattaaccccagttccgggaatgcctctaagatttccagtttatctattgttccttgtgtaagagcaggtacttactgtaaatcctgcccttaggtcaaaacaaccttgatgttatcatacttaccataaatcctgcccttagcaattgtcctacacattccttctgaagcacgtataccctttccctgtggtatataagccctgggtctggggggtaacggcgcggggatccaccatcttgtctcgccgccgcccaagacacagacgtggcttctgtttgtaagtccctattaaatgtttctttctgagaaactggatttgtcagcctctttcttcggcctctcagcttccttggacttttgggggtaggtttgcatagacctgctcaccgcggaaca

SEQ ID NO: 258 - DNA, 443 bp, Homo sapiens
  repeat_region (1)..(443): ltr47b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggaggctaaagtaactccatcttggaagctaatccgccatgttgacttctgattaaccccggttccaggaatgcctctaagatttccactttatctattgttccttgtgtaagaacatgtacttaccgtaaatcctgcctttagatcaaatcaaccttgataatctcatacttaccgtaaaccctgcccttagcaaatgtcctacacattctctctggagcatgtataccctttccctatggtatataatccctgggtctggggggtaacggtgtggagatctacctgtcttgcggccacccaagaccacgcttctgtccgtaagttccccaataaatcaccctttactgacaaactggatttgtctgcctcgttctttggtttctcggctccttctgcgtttgggggtcattttgcatatacggccctttcacgaaaca

SEQ ID NO: 259 - DNA, 787 bp, Homo sapiens
  repeat_region (1)..(787): ltr48
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttggggctcagaaaataccccaaagtatggtgctttggcatgctgagtactttgaactaaaggaaattggaaggccttagaagcagccntcagaaccaaggtctntctctgaccttctcttgcctccctgtctctctgcccctctttctttccccaagcacagggagggnctctctctgaaatttccttatctgactaaggaaacttctttccaaaagaaatgcaattgtcttgaatccccntccctaggaatctcatcaaataaccaggaaagattaaccacatgagaagagaagagactaaaagtcatcaaacccasaacaccacacccagacagacttttcatcatctattcttctgagggcagctctaagagattacctgagagactttttatctgcataataagacaacctttgttcacagtgcagttctgcccctcaccttcctataatttgttctccaccacctccnccagagcccagagaaactttgtcccaggccattggtctgttctttgggcccattcatttcccctaaaaatcatttactacccctctaaaattgcctacatcccccccatttccctctcccctatgaagagggtatttaagcttcaaccatctggcccttctttgagtctcatatanattttgtatgactcccatgttcatatgcatgttaataaatttgtatgccttttctcctgttaatctgtctattgtcagttcatttcagcaaaccttcagaggggacagaggggaagctttcctttcncccctaca

SEQ ID NO: 260 - DNA, 676 bp, Homo sapiens
  repeat_region (1)..(676): ltr48b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tggggctcagaaaataataccccaaaatatggcactttgacatgctgaactgaagaagcagcctcaaggtctctctgacctcccccccccctcccnnctcccgtctctcaatcctctgtctctcccaaagcacaggatgaagctgttctctgaagttcccttatctacctagaaactggacctgccaaagaagaacacaattgccttcaatcccttccctgaaatttcattaactagagaagattaaaactcatatcacaganaaaaaaagactgaaaattaaacaccacacctagagcccagacaaactttgtcacaaaccattgtctgttctctggtcccattcaatttccaaagagaattatttacaagcyattgtctgttctctgggcccattcatttcccccctaaaaatcatttactacccctcaaaaaattggcctacaawtttgcctacatttcccccatctccccttcccctatgaagaagggtatataagcatctgtaccccattgggttattgggtaatcattctcctctgtgattcccccatgctatgcacgttaaaataaatttgtatgcccttttctcctattaatctgccttttgtcagttgattttcagtgaaccttcagagggcaaaggggaagttttcccttggcccctacaagggca

SEQ ID NO: 261 - DNA, 595 bp, Homo sapiens
  repeat_region (1)..(595): ltr49
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaaggaaatcaaaatatttyaccccaaaatatayttctttgacatattttgagatggctrttcagagggcctgcaaacagaagtagccctgcaaagctgtcttttgtgggggagatttgcatctgtagagaaaatctgcattgatgcagccaggctttctctgaggccctcccttgtctggatctaggaaagattaactgagagtctgacacctttaaaggtctgaaagaaacatttaccatctattctctctgagggctgctacctgtgaggtttcatctacataacaagaccacctttgctagccaggcctcctcttctctccctcccataacctgtcttgccactataacctgatttaccaccataacctgttttgggccatgctccgagcccccattctttctgtaacctcaagatggtatataagcttctgtaccccattggggggagttttgggtattcactstgattctcccgtgtrtrcacgttaataaatttgtatgccttttctcctattaatctgccttttgtcagttgatttttcagcgaaccttcagagggcgaaggggaagttttcccttggcccctaca

SEQ ID NO: 262 - DNA, 969 bp, Homo sapiens
  rerpeat_region (1)..(969): ltr5
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggggaaaagcaacagaggtcagattgttactgtgtctgtatagaaagaagtagacataggagactccattttgttctgtactaagaaaaattattctgccttgagatgctgttaatctatgaccttacccccaaccccgtgctctctgaaacatgtgctgtgtcaaactcagggttaaatggattaagggcggtgcaagatgtgctttgttaaacagatgcttgaaggcagcatgctcattaagagtcatcaccactccctaatctcaagtacccagggacacaaaaactgcggaaggctgcaggggcctctgcctaggaaagccaggtattgtccaaggtttctccccatgtgagagtctgaaatatggcctcgtgggaagggaaagacctgaccgtcccccagcccgacacccataaagggtctgtgctgaggaggattagtataagaggaaagcatgcctcttgcagttgagacaagaggaaggcatctgtttcccacccatccttgggcaatggaatgtctcggtataaaacccgattgtacgttccacctactgagatagggagaaaccaccttagggctggaggtgggacatgcaggcagcaatactgctttgtaaagcattgagatgtttatgtgtatgcatatctaaaagcacagcatttaatcctttaccttgtctatgatgcaaagacctttgttcacgtgtttgtctgctcaccctctccccactattgtcttgtgaccctgacacatctccctctcagagaaacacccacgaatgatcaataaatactaaggggactcagaggctggtgggatcctccatatgctgaacgttggttccccgggcccccttatttctttctctatactttgtctctgtgtctttttcttttccaagtctctcattgcaccttacgagaaacacccacaggtgtggaggggcaacccaccccttca

SEQ ID NO: 263 - DNA, 795 bp, Homo sapiens
  repeat_region (1)..(795): ltr50
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgccagttattaagctattgtctctcagctccaaacccacccttctatactctgctctgtgatgctggggctgggactcgactctgcaaaccacatttctgctttgccagctggctctccctgttaggctctgccaatagggggcgctagagggagactgcaaggggctggaggggaggaagaagggacttgctccttcctgtctgctgctgtttcctgtctgcttcctgttcctgtcagcatcaccccagcaatgcttcttcaccctggcagcagttgcttccagttgattccagcagcagcagttgattccagtttgcrsagttccagtttccaacantttytcccaacactcccagaaccagcctcattgtaccccctcctcctcctcagagacaccagcaccagctgggcagtgccccctcctcagaggtctgagtcccagctccatggggcccctcctctgagctcagagacaccagcaccagctaggcagtgccccctcctcagaggtctgagktcccagctccatggggcccctcctctaagcttctaagttttaataattccaacctcttcccttttgttcccccagccctagggggtggtggtagctgcttcctgcagttactacctctgtgataccttagtgttctctttttgccttttcagttctctaatamacaactttatacctagttaacctaagttaacaattctttatattaaattctctctgttaaaataactggtgtggtttctgtcttctcctgactggaccctgactgataca

SEQ ID NO: 264 - DNA, 671 bp, Homo sapiens
  repeat_region (1)..(671): ltr51
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgatctgagagaccaaaatagangcccctttatcaactaagacgggccctaaggttaaggaaacaaaagttacctacgggtcaagggttcagggcctggctggcatggcaaatttctaaattcctacaagaaaaaccacactcttgctaaactccctaacacaataggagctatcaggcaaattatcananccctcctaactctgatttacaacccagaccactacaactctgattggacagaggactggccttacaaacattcttttctgataagaaactgcagaccataagccagttttggccagtttanagaggctgcacacaaactgtctttgtgtcctatagttcaccttttgacgtaaagagccaaattntacttcattttaatgctaaaactccaccccaaagtgaacatgggatgtatgttacatatatgtttacccattgcacatgtgctcggctcccctcataaatatttatagcttttcccccaaacctgctgaatatgtatgtctccattgtgtaataccaaccctgtgaggcataaaacccaacctgccctttccctctttgaagagagagcgcctttggtctatgccagagactatctcttcccagtttgcaaactgatattrccaataaagctctcctttctactatttagcca

SEQ ID NO: 265 - DNA, 421 bp, Homo sapiens
  repeat_region (1)..(421): ltr52
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaataaagagtctgactccattttttgatgtttgactgctgacagcttttaagcctcacccctccctcttccctttgccccacatctgggcaagctgataagaaagcccaggtgctccctcctttggtactagcaggaaattcaaaccatacaagcccctgcctgcgggaaccctcaccccagccccacccccctaaccacaataaaaaccccaagccagtctcctttccctgctctctcaagacatttttggacctgcttgggaggcctgccctgctctccccagaaagcctcaattatgtaagtaataaaccttttcataccctcttggtgtgtgtgtggcatcatcagtcttaacatccaaaccaaattttgggtgggggagtccatcctgcctctgcagagtgaccayaacaaca

SEQ ID NO: 266 - DNA, 519 bp, Homo sapiens
  repeat_region (1)..(519): ltr53
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggtgtaaggcctaaaattaaggcccaatattatgtgctgccttgacatctggtgaaatcaggagggcctcaaatggcctaactacaagttcccctccccactctgctcccatggataaggtcccctagccaaacaaccctccttatcaaggggaccaggcacagttcctgcttatccctgntgagtagygggtttcagttccctgccagcccgtggaattattcaaayaagccaatcacatcctcctgcgggaaccaggggtcacctcaccctcttgatactacaaagcctgcctcccacagcccctggttgttcactctgttcctgagtgcaacccccatgtggccctgtgtggnatgtggtgtcctcctcccccaggctgtgagtatatgtgattaataaactgctgtcaatctcatctgtccagtgttgggtgtcatgtgtttarccatccccataaccctagggtgggaatccctccctcaccaatggggtgaagaggaggcaatwaaaaca

SEQ ID NO: 267 - DNA, 510 bp, Homo sapiens
  repeat_region (1)..(510): ltr54
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttaaataaaatttataggaggccattgttttggactaagctcctgcactaggccccaacagaacagaccaaaccaaaatggagtcactcatgctaaagttccatgtcaccaagctgaaactaagttgtttatctgaccttccaagaaatcaggagagagagagagataacagccaaatccccaaacaggccagttttagccagcatgataaggaagtcccctctgctttaacctttaacctaatgttaagcaatcagttacttntctattgttctgtntccctgtnttaaccttacaaggaaagtaactttgaaatgaccaatctgctttttgttctctgtttctgctttcttcagcccttttctgtctataaagccaacctcctctgctcagctcatyggaacactcattctattttatagaatgaggtrttgcccaattctagaatcacaaataaaagccaattgagatctttaaactaaatttgttgtaattttgtcttttgaca

SEQ ID NO: 268 - DNA, 548 bp, Homo sapiens
  repeat_region (1)..(548): ltr55
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttatataaatgagccaaagatggcctctgtgtattggcccctaggttgtttatttcttcactgcaggctgagacctgttagctcaaaagcccaccggcaccaaactcaaatttttacacatccawattgttttaaaaatagcccaaacaagcagatttttagccatttagagcctgcctgctttgcataccccgcgaaacytcacccaacatctgctagccattgcacttataagrccccaargcgctgctgcyctttggagctctctgacccagagactcccyaaccgtgctgctgagaaacatcacttagacacataagccccctctccgattcccctctcccccgggagttcccttgccctcctccccttctggatggtggtcccastccctaaacctctrgacagtctcwtgctgtgaggagcttccccttcatgcaaccctgtccaagtgccacccaataaagtttgttgtgtggtactgcccctgcgtggtcatatctttttccttgatcagcccccaaatcccttraacccccttcaca

SEQ ID NO: 269 - DNA, 445 bp, Homo sapiens
  repeat_region (1)..(445): ltr56
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagaattaagaaaagaacttttatctgaggaatgcaagtcttttaaattatcaggcccagagagacattaaaatgagaccgcaatcacgtcctactccccactttgagctatgtatttcatctcttgaaactgcttgctattgccacaagtagctataaattaacctaataatgccacaccrgacactataacccacaccctatagcttaacaatgtatatggccaatcactaatcaatgttatttctgtaaaccaatgagaattyctgacaaacaactttgtatcagcccactccctgtccccctcttttttgcctttaaaaatccacttgtaactgctgctaattggagtgtatattcagggcaacttgaatctatgctcctgggttgcaatcctcaagctttggctcaaataaactctctacttatattaattttgcctca

SEQ ID NO: 270 - DNA, 411 bp, Homo sapiens
  repeat_region (1)..(411): ltr57
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtagtgtgacaggtcccccaaccaggttacttaagggtgtatgtccgctgcctgaaccctgaaggccaggtggtgagccaaggccatggtgcccagctgaggagcaggtgtccctgagaacccaaacatcccrgagagtatctgagaacctaccaaggaaaacagtcccattacacacacacagtaggcaaagagccagaaaattagcttaaaagcagcttagagatgggaggtggcacggatctctagagctgtcctgctgccatccaggagtgccctgtatgtaagtcctaataaactcatctacttatcaagctggacttgtccgagtcattctttggtctctcrgctccttcccagtttggggggaggtatttttttatatacagtcccaggtttttcttgtaaca

SEQ ID NO: 271 - DNA, 679 bp, Homo sapiens
  repeat_region (1)..(679): ltr58
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagacagtatagggaagagactcagtcctggcagacaagagacatggtaaccaagatcccaatgggcctcacatgtccaggcatattccctcccctaccttcttgcctcccttaacaagctgacccaagtcacgtagcagaaagggggncctctcctaacttagctgaccaggctgaattcctaaccataaaaggaagaacctaaccatttatctccttgagtnatgtcttccaaggttgctgaagcaggactctggcattcctgataagaacctgaccagatgcagccggctgaagacaagatggactccagcgctgacctttcaccaagtttttcttcattataatctcattgtaatactaaaatctccgcccarggtgggrnttatctgccahtttctrgacatgcgatgcatgttagagcatgacgtctcactgcgcaggcgctaaaaagaccccgcctaaacatgcttgcctacacgtcgctcctttttcctgcctcaacttccttaaaatgacaagagccgagcccttttgggagctagcatcaggatccctttcctgtacgctgctcccttgcgctgctcgagccgcaagcctattaaaccttgcctgagaaaatcggtttggcctggtgttaatttctacttacatgagagccaaggaacttggggtcca

SEQ ID NO: 272 - DNA, 597 bp, Homo sapiens
  repeat_region (1)..(597): ltr59
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagaaataaaaataaaattctaagcccccaactgactgaacagaccccctcttggccgagggaaccccagagaaaccttggaagctgarttcacggccataacaggatgggagatcagacacgcctcattataycccctccctcgctaactaccattaggttttcttccctaagggctaaacagaaaccagccctttcaaaagtctccacactgataatgtccattactagcttatcttcccaggtacagaacaaagacaagatgagattaatcattccttcacccctccccgagacatctgcttantttnttcctctattcccttttycttcaaatgttcaccttatcttatgtaaaatgtagatttactgggcactaactaaagtctcacaagtatgtaatcattcgtctcactgccacccccttttttaaggaaaatgtgtaaatactaaacctcctgagaacctctttggaaaaaacagccacagatgcttctgtgacttacatttttcctrgrtgtgccctcaagctggctcagtaaacctcgatgntttgagacttatacctcaatcactcattttggttatcacyctca

SEQ ID NO: 273 - DNA, 586 bp, Homo sapiens
  repeat_region (1)..(586): ltr60
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttagagtaggcagatagccagacatgagcaggagnggaagcccctgrgaaaaggaaggtctggaaaatctcacacccsagagaccacccaaaanatacataytagatatgagcagagangaggggaaatacctatgcagaaaaaaatgccccttaagatgcccagtaatcattcactctgcagttaaactgtcagaatgttgctagctacatgctgataagggaagagggcaaaggagaaattcctaagagataygcaggtgcagtaagtacagatttgaccactatacaaccttcctggggtggcagtaatgagcaatgcmgccattaggtagrattcatatccaacaccgggtccgtgcatgcgcatcaaccaacagtaagggaggvtcccacaagcctgggtaggaactaggtggggaaargcagggacttaaggcagaagcaggaaaactagasaaagaaaaaggtggagacttaagacagaggtgggaacttcaaraaaaatcygacatcataaaaaccccgtgcagactctcagggctgctgctggctcactctctttcagcagcccrctctgcctca

SEQ ID NO: 274 - DNA, 595 bp, Homo sapiens
  repeat_region (1)..(595): ltr61
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaggcagaaatttaaaaataataataagtactgcattcattcactccaagaaaagtaaaagccaaggcccagaatgtggcaaggcaagggttaaaaagaaaaaaaaaargaacaagttttcctctgcctagccaagctcacttcaaggacagttataagataacgctgtycgaraagccaaggccaaaggaatgggctccagacacccccccacctccagagcaaggttgaaggaaaaaaagagaaagacaaattcctttactgttactcctttccctggcntcttaagcatgactatgttttacaaatgtctgtatttagccagttcttgtttttctttygacgcagctacaaggccaccagctatgcaaggccacaagttatgttatgctatagattatgtgacctgtcactgtatgattaactgcctttgttttgcttttgtaagcctgcttataaaaaccccrctctgtctttgttcaaggctcagctttttggatgtgaatccactgagctggtgcgtaccttaaaataaataacaatcctcctgtattcacccatattggtctctctagtcctcagtttcccrcaaca

SEQ ID NO: 275 - DNA, 719 bp, Homo sapiens
  repeat_region (1)..(719): ltr62
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtatagagcacccttgacataagtaactccatcttagaaaaagactccatcttacatttcaaaaggcatcttgccaacagggaccagatgttttgcctaatcaataaagactgcayccaaccagataaggacataaacaagcacactcttccactatcagtcctcaccagaggactctgtggccataaaaagagcaggacttcaccagctcaaaatggccatcttaacagacaccgtcttgctgtcacttgtgataagcacccagcatctgccaccaaaggctctgcccacatcaaagactcttccttgcaagacantgaggctgacggactgcctggatcaggccaggacactctttttgtctacgtcactctccctggactggttcgttaaccctttttcctatcccttttctcttgatgttaaatgttactttgtttgttgtggaatgtttaatctataacatttatatattgattaagtatactattatgtatggtttgcaatattgactgacttgtggagtggcttgagcctgtgtgcccatggctctgactaccgagtgaaygggaagtactaaggagaattgcctccttgggaactccatgtagctcgtggcttttgtgattgaaatagcatcaataaaagtctgacattgtggaaagacacaaanatgtgtggacctggttatctctgaccttgcrctgctcacgacaca

SEQ ID NO: 276 - DNA, 557 bp, Homo sapiens
  repeat_region (1)..(557): ltr64
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gtgagacaaagtaacaaatgtaagaagccatgtctgctcatttctgcttgccaacataatttcacaaagcccctgactctgtgatgacatgcagctctcnagaaagatgctttgaagacaaarcaggatrgagcacacagccccccayrtctcttgcctgagtcactayattccttaaaagataaatgaccctagtccttgccttttcctacacagaagataatgtctgacagggttagtgattatgcctctgtaatctataaccagatgtactcttacacccaaactttgatgtgattctgctctaatgtaacttctgagcaagtttgatgtgattanttctngcaagtttgatgtgattttgcacgtactgaacctctaccacctgtatataagctgtgggctgaaacactgttttggagcagtctgacagaacctctctgaaagactgctcccaggctataggcntycctcagtctacagtcctcagtaagacttctgaataaaactaactttaattctttaaaagcttgatttttttntttctttagttaaca

SEQ ID NO: 277 - DNA, 669 bp, Homo sapiens
  repeat_region (1)..(669): ltr65
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagaaagtaaaaatctgccctgccattcatcaggctgggataacagacacagataaagccagctgcaaagtataacaggaaacaatatttctcccaaggacatactgcagctgtaaagtgtcataacaancctccttctttgagtgactactgctttcttactcactgagaaaccttgttctctaaaatcatagactatcagaaactttgctgtttgaaattatatcagtaagaatgaaacatcccactcttgcctggaggatctaagtcactttgacacagagaagcagcctcaatttccaacccaggtgcagagcttcagataaggggtttctggacacaacattccacatttatcttaactttgtagtttccaaggaaacaggaccctgggtccactttgcagtccaggacctgatgttgacccctttacacacagccctgctttgctttgagcctatcannntcaaaacactgcttcatttaaatttcacctaaactccacccttcccccaaatcctataataactctatcttttcctttgtttggtgagatgctccatggttcctctggtgtgcagtctccctcattgcaataagtcaataaacctgactttgttggactacaggtttgtccctggtggtcttaggctgattgggctaggaca

SEQ ID NO: 278 - DNA, 610 bp, Homo sapiens
  repeat_region (1)..(610): ltr66
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttctgtgcgggaaacgcgtgaggggagaagaaaagacacacacacaatacctttaagggtaaacaagctttatcccacgtaaatggcaatgcagatataataagcaaatgatataataagcaaattgatataataagcaaattgcaatgggaaggggagaagggaaaagatatatatatatgtatatatatatatatatatatatttacactcaccagactatggaggattcaccaccagactgggaagcaacagcctgggctccagagtcggccactcatccgtgcacagacgaggagaggtctcatgaagcttyggygcagtctgggaccctagctctttttgtaacgagttgtttggcatgaggcccagtcacgagggcccttcacgactgggctcaaggaacacaaaaaggtcaacttgtttttgtgattgtctattgtttttcaataactaatgtataggaatagattgaaatagagatttctccgaaacagcgctggatgaatgcctcaaggggctcacacaacctgttccaggacttggtgaccattgtttgtgtccatgttcaattgagttcaaatttaatatttaacttttcctccaca

SEQ ID NO: 279 - DNA, 566 bp, Homo sapiens
  repeat_region (1)..(566): ltr67
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtcattyttttggcnactcagcatttgaacacccttcctatgtttggggaatttcccaccttataaattctacctctttaaggtagaagccagaaanctcattttcccagcctcccttgcagctagggtgcwggcatgtgacctaggctccgccaatcagatgcacccatgcagcaagacttcaaattagaagctagtgatgcaaagaagcaggtgccatgcagaatccactcnngggtgagagtggcagcagctggcagagagttttcagaggcaggagtggcagagatccaagtagtagtgtccagtgttcatgtgtggtgcaagtggtggtatgcagtgtccagtagtagcagcagtggtatcctcactgtgaccagttctgcagtgtgatttgggcngcattgttcctggctgtatagcctctaagcctggttctctagccctcctagagattctgtgagctacctaatatcctttaatattcctttaataaattccttttctgcttaaattagccagagttggtttctgttgtttgcaactaagaaccctgactgataca

SEQ ID NO: 280 - DNA, 563 bp, Homo sapiens
  repeat_region (1)..(563): ltr6a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgataccttaccttgttttaatatgacacagactctcccttagctgagaaagccagacagactccatttggctccttcatttgcaagacatcaagggctccttacccacccccttcctcaaggactcgtgcaagctgactcccagcacatcaaggtagtgcaattaaccaataaggtactgtggcaagttatgtccacagttcccagaaattcgcccaagtgatagtaccctaagcccccgcgtttgtgtctggtagatagcagccaaagccctcgcacctatcaccttgtgatgtgatggatttaaagcccctgcacctggaactgtttgttttcctgtaaccatttgtctttttaactttttttgcctgttttacttctgtaagattgctacagctaggcttcccctcccctctctaaaccaaagtataaaagaaaatctagccccttcggggccgagagaattttgagggctagccatctctcggtcgacagctaataaaggactcctgaattaatctcaaagtgtagcgtttctccataactcgcttggttacaaca

SEQ ID NO: 281 - DNA, 450 bp, Homo sapiens
  repeat_region (1)..(450): ltr7
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtcaggcctctgagcccaagctaagccatcacatcccctgtgactagcacatatacgctcagatggcctgaagtaactgaagaatcacaaagaagtgaaaatgccctgccccaccttaactgatgacattccaccacaaaagaagtgaaaatggccggtccttgccttaagtgatgacattaccttgtaagagtccttttcctggctcatcctagctcaaaaatctcccctactgagcaccctgcgacccccactcctacccgccaaagaacaacccccctttgactgtaattgtcctttacctacccaaatcctataaaacagccccacccctatctccctttgctgactctcttttcggactcagcccgcctgcacccaggtgattaaaagctttattgctcacacaaagcctgtttggtggtctcttcacacggacgcgcatgaaa

SEQ ID NO: 282 - DNA, 691 bp, Homo sapiens
  repeat_region (1)..(691): ltr8
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaaaccgcctttgcaaaattatgactgagacagtgaaagagatctaacttwactgactccatcttgcttctaacctccaagctgtccttgttcattcctgggcgtaggctgaactaactttgggagaaacttagtttatagtttatagtttaaacaaagacggtaacagccctttcccaaagcagacctccttcttgcctggggactagattgcctttgtaggactaacattagccgcaagattagaaattatggtttaggagtcatgcagctggaggctacaagattctgaccctccctaaactgctcctaagatcagtgcttgagatattttgcagaccctgcgcttgatggatcagctggcaccacccagatcaataaactggctcatctgatcttgtggcccccacccaggaactgactcagcgcaagaagacagctycaactycctatgatttcatcyctgaccaatcagcactcctggctcactggcttcccccnacccaccaagttatccttaaaaactctgmtccctgaatgctcagggagactgatttgagtaataataaaactccggtctcccgcacagccggctctgcgtgaattactctttctctattgcaattcccctgtcttgatgaatcggctctgtctaggcagcgggcaaggtgaacccmttgggtggttaca

SEQ ID NO: 283 - DNA, 727 bp, Homo sapiens
  repeat_region (1)..(727): ltr8a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaaactgcctttgcaaaaattataacagtgagaaaattatgacagtgaaagagatctgatctaaccaacccccatcttgcctttaacctccaaactgcccttaatyattcctgggcttgggccaagctaactttgggagacatttagtttatagtttaaatgataatagcccttccccaaaactmaaccgcctttgtaaagctaatgaaagaccaccaggytaggaggatgagaggagcctgaattctgctaaggtgtagacataaacgattaccagccattattccagaggtcacaagatttgcaacttccccaattactcctgcagataacatcactattgtagaacctaagattggccttttgagatatcttttcaggtttttttgcatttctgacaccaatggctccacctggacccgccaaccactcctgtggccccacccagaagtgactcagcacgcacgaggaccattttccacacccctatgattgcatccccaaccaatcagcagcaagcacccattgcctagccacccccaccccctgccyaccaaactatctttgaaaaaccctagcctctaaattttcagggagattgatttgagtaataattctgtctcccacatggcgtggccagccttacgtcaattaaactctttctttattgcaatgccatggtctttgtctgtgcagcgggcaggaagaacccatcgggcggttaca

SEQ ID NO: 284 - DNA, 645 bp, Homo sapiens
  repeat_region (1)..(645): ltr9
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgatacaggagttaaaaagaaattatttaggcagatagtgagggtaagggagtcctcggtaaggttttccttttaacgaaaagcagcccccaaatcattttcttttctaacaaagagcagcctgtaaaatcgagctgcagacatagayaagcaagctggaagcttgcacgggtgaatgccggcagctgtgccaataggaaarggctacctgggggcyaggcatgttcaanatggnggctccatcttcccttctctttgtcagccacgtgtacagtaaggagcagacaacatggcgccggccargtagagagcccatttgcataataaaagattagggtggggcggccagccttccccgcgcgctatgyaaacgkcacacctggtccaaccaatctntgngccctatgtaaatcagacaccgcctcctcaagcycgtctataaaatccgntgcatytgccaccagccggncttttccactcgggnacccctctctctnnagagagagagagctgttctcctttctcttttcttttgcctattaaacctccgctcctaaactcactccttgtgtgtccgcgtccttratttycttggcgtgagacgacgaacctcgggtatttaccccagacaacgangccgcttca

SEQ ID NO: 285 - DNA, 644 bp, Homo sapiens
  repeat_region (1)..(644): ltr9b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttgtaggagttattaagaaattattttaggcagatagagaggaaaaggggtccttgggaagttttcgtttcttttnaaagcagctccagaaacatttcttgtctagcagaaaagccccggctcttagagccaggccggcaanctttgatatgcaaatgcaggccattagaaactgggtccacccaacatggcgattcccaccgtcgtcttcttgcccttgccccacatgtgcctggcaacatggccgcccccacatatccccacgtgtgtagaacatcatggcgccctgcatttgcatattaaaaggctagggtgggagggccagttttttcgcgggctacgtgaatgacatgcctggtcaaaccaatcccctgagccctatgcaaatcagacaccgcctcctccagcctcctcatataactggctgntwtccgccgcacncggggtttcctctctcggctttggagcccccctccctctgtctctgtacaggggagcttcttccttctttcttctcccttctttcttgcctattaaactctccgctccttaaaaccactccacgtgtgtccgtgtcgttttatctaaatcggcgcgaggaccaaggaccctggtgttcctccastcatcggagccgtatca

SEQ ID NO: 286 - DNA, 80 bp, Homo sapiens
  repeat_region (1)..(80): madel
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttaggttggtgcaaaagtaattgcggtttttgccattactttyaatggcaaaaaccgcaattacttttgcaccaacctaa

SEQ ID NO: 287 - DNA, 471 bp, Homo sapiens
  repeat_region (1)..(471): marna
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttatacatccaaatgaatgttntcnttcaaagtagtcaccttgggaaagctatacatttatttttaaccnawcacaattctgccattgatcaaaacatttttggaacttctcttttggaattgccttcagaaccagtttatgagccacataagaaaatcagtctcattactttatagtcacacctcatttttgaccaaaaatagtattacccagtttgatcacccaccttattcaccagacttggctctgaatgacttttggctgtttccaaaaatcaaatccaccctcaaaggataaaganaagatttgccaccattgaggatattcaaaagaatatgctgcaggctctgaaggcaattccaaaaagaatgttccaaaaatgttttgagcaatggcagcatcattggaataagtgcatagcttcccaaggtaattattttgaaggggacaactctcatttggatgtataa

SEQ ID NO: 288 - DNA, 1264 bp, Homo sapiens
  repeat_region (1)..(1264): mer100
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gattccagggtaakcttacaagacataaattcattcactgcatcattcataggcaagctaytrcaacaaagatgttgaarccagaggtacamaaaaggctgcatgacgttactaatgttaatgttataaaaacaaanctttaatatcttgtacagtagaatctatataatactttgtaataaawtgggaartgaccatgaaaatcttttgtaccacacagaagtttgctagttatcttgtggcaaagtacttaattaagagttgtcaaacttaaagatgagttatattnatttttctttttacaaaaagacaagtgttccaaatttgactgaccttttctgtgatgacaagtgactgtcagtagtatgctacctagtagatatttttgaaaaaaataaacgcacttaatctgtcccttcaaggtaaaggtgtcgatattttaacaatgagtgagaaagtaactgcttttgaargaaatgcacaatatggagagancattttgaaaatagatgtttggaaatgtttccattgttatatgattttgtngccgaaaatgatgtaagtgtgatacctataaaaactctcatatctgcacactttaaaacttggaaacagaaatttctaacctgctttttaaaaatcttccaaatgaagagttttaagtgggttttgaacacatttgttaaaaatattaaaatgcaacatcttccgattagtttgcaagaacaactgattgacatcagggaaaatggaaatttactagccaaatttcaacaaaaacctttgcataattggtagatgggattgaaaaatgagtatcatgatttagtaagcacagccaatgatatayttcttccatttggatctacatatctttgtgaggtatctttttcagctatgacagccattaaaaccaagtattgaaataaagtaaaaaccagaccttcaaatcactgtatcaaagtgttaaaccaagatttcatattatyctagcatttaaataatgtyagatttttaaaaaaaagcatattcaatcatattctctcattaaaaaatwaataataaaattttaatgaatatataaaargttttatatacaattataaaatwtaaattattttaaawtatatttyatctttatctcatccttttaaaatttsttttntgtatatgctttataatatgcatantaagagtagtacatgcatataatttawaaattaaaatacayatgttknaantayatgttcaaaatatttttatt

SEQ ID NO: 289 - DNA, 474 bp, Homo sapiens
  repeat_region (1)..(474): mer101
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgaacaaatgtgaacctgaaagagccaatccttcaagatggatcccgagtggctaactgggcctaaatttaaaatagagccaagcggccatttgctgactagaggtcacacacgtactctgagttccccgaaaacccacacctctgtttaactttgggactttcagagctcacctgaaccaaccaatcagagctcacctgcmtcaaccaatcagggctcagctgtatcaaccaatcagaactcagctgtgtcaaccaatcagaactaagcaagtttgaatccttcatttgcataaacggacctgattgggaacctgggcaggaacttttgctataaaacccaaaccctccctttgttctctggaaccgcaccttcgttttacaccgaaggctgcatctccccggtttgcaaactgttcactggaataaagtctctttcctccaaattccttttcagagaacttttgttcaca

SEQ ID NO: 290 - DNA, 570 bp, Homo sapiens
  repeat_region (1)..(570): mer101b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttaaagtatgcccctagctgacagacaaaatggactccctgtggctaamtgaggtgctcaaagttaaaacagaaccaggcagccatggctgggtgagggagcagtcacatattctgtgttctcagaaagatgtaaaagtntcacaggacctccctttctacaatcaagccaaaccagttcctattgtyagtgccaagataaactgcngccagaaaccacctccccacaagcccactagaaacaaacatctgacagagacttctgatttggggcttggaaaccaaccaatcagagctcacctaccccagccaatcagggctcagctgtatcgaycaatcagaactyagctgnnccaaccaatcagaactaagcaagtttcaatccttcatttgcataaatgracctgattgggaacctgggcaggaagttttgctataaaacccaaancttcctttgttctccggaaagcaccttcattttacactraaggctgtgtctccctggtttgcaaactgttcactggaataaactctcctccaaattccttttnagagaacttttgttcaca

SEQ ID NO: 291 - DNA, 332 bp, Homo sapiens
  repeat_region (1)..(332): mer102
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gggttgcaaactcaaatgcctacaggggccaggcaggtaacataaatgagtgaagtgggccaggtggggactgtggcaaactggagagcacatgccctgtctaaagggggcagcagctgctactcagctccagccaattgttgccatgtgggaatgtaggcccagtgttgccagatcttctgatttttcaagagaagccagaaatctagatttttatgtgaaatctcctgatttttaaatgttggcaactaatttaaaatttttawaaaacactgtgtaggccaaacaaaacatatctgtgggccagatttagcccatrggctgccagtttg

SEQ ID NO: 292 - DNA, 166 bp, Homo sapiens
  repeat_region (1)..(166): mer103
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
agttccatggtcaaataagtttgggaaatgctgggttaaacaaagttaaacaggtttctttactgcaggacttctcagagcctttaatatgctaatgtgcattgtgaatctccaagaggggaaatatagtatgcagtrtttcccaaatttatttgaccatggaact

SEQ ID NO: 293 - DNA, 185 bp, Homo sapiens
  repeat_region (1)..(185): mer104
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
taccatatttcattgaatctaagatgccatcaattgtaagatgcaccattattttatgtaccactaagaaagaaaaaaatgctgccaattaaactataacatgccattaattgtaagatgcatcccaatttcagagatgttaaaatgtgaaaaaatgtgcatcttagaatcgatgaaatatggta

SEQ ID NO: 294 - DNA, 204 bp, Homo sapiens
  repeat_region (1)..(204): mer105
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagcctttctcaactagggttctatgagagaattaagccctaatgccctaaggcatccattgtatgtaatgaattaacttctctcctatgcatcctagaatggtactagttatataccatccttgggagaattgagaaaatagtcactcaaatcattttctgtgttctgtggttcagatgaggaaccctggttgagaaaggctg

SEQ ID NO: 295 - DNA, 258 bp, Homo sapiens
  repeat_region (1)..(258): mer106
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cctatttacattaggccatgcattctcaacaggggcaatattgcccccaagggggtgaaaattggttcttggggggagaaaaaatcttagatattacaatggtttgtggccctccaaagggccacagtacataaacagatatacagtatatctgtggtattaaaatttcatggggaagggggtattaggaaaaaaatgtctaaaaaggctccttagggggggaataatgaaaaaaggttgagaaacactggtctagag

SEQ ID NO: 296 - DNA, 197 bp, Homo sapiens
  repeat_region (1)..(197): mer107
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggggtgtccaagggagagaatacagtcatgggttcttagtttctgtttctggttgggccagtaaagccccttcctcatccctcttttctacttatcactagagacagaaactaaaaaccatggcttcaggctgctaaaagcctaaaacaaaacaaaacagaacaacaacaaaataaggcgggttggacaagcttg

SEQ ID NO: 297 - DNA, 633 bp, Homo sapiens
  repeat_region (1)..(633): mer108
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
antacacctngcagttnnmncacagtttcactgtaaattttaaacacaaataaaaantccaartggtcacatagaatgatagaattgaantaactcaagttctgttgtctttntttttacaatcactatgctatngtttaaatacaggaatatgtagtaccacaggggttggagacatgaantnactgtacccgaagtgagcttgaatgrattctaaactattangaacttactctagaaacaaacatatgtagctgagtccacgtgtgttgggggccaactgtataactggaagttctctnaattaacttccatgtagaatacaatgtttattaaaggataagtaataaaaatgtgctaatttgaagtttacatatatattattaaaactcaacagtaactgcagcaattkgtttagaacttagaccaacaaaagattttttttttwgggaggagtattttatcactgacattgtttagaattgctggtgcatggtgataataamaaagcagactgacttttagtcagttttattattgttaattctctacagacaatgcacccccttattgcctgcacctggggcggaccactcccactgccctgcccttggtatgccactggtttcctac

SEQ ID NO: 298 - DNA, 1994 bp, Homo sapiens
  repeat_region (1)..(1994): mer109
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aaagactagatntttcanatyagaacttaannttgtccactatatacacagcantgttaaataaaatngcacacacataacaatggttanaatctgaaatatcttctaaatatgaacattttggcctagaacctttcttttctcacttccttctctctgccttcaantcagtggacaagtatangcatgtgtaatgctctagagatggtttaacaaatttatatccaaaagtcatttccagaagacaanccttnctatraantttaacaaaaagtktacaaaaggtgctaattctactangtnctttgtcatacactggcagcctctttaacatctagagactagatgttgcaaaattaggactcatttgtccattatatacacnatatacaaagcaaaacaaaatgcacaanacatacagaacaagagttcctgaaaatgtgcaattatnaacacactggcacadaaccnttcgcacttccttctctcccanctcctctaaaccactgaataagcacagacantaatatacngctcaaagagatggtttaacaattccattyccmaaagacagtntttcctrtgaattttanntaaaagtnacttaaagngtgttattttactacctctacatttaacatacattangcacttcnraacatctagaaagactagatrtttcaaanaagnacttaatttgtccactatatgtacagtagcattgaataaattgcacacatataacaatggttataatttgaaagtgtcttctaaatatgamcattctggcctaaaacccttcccatctccatcaacycagtggacaataatgctcaagttttcagaagacantctttnctatganttttaangcaaaatgtacaaaattattagtttactaactctacttttgtcatacactggcaacctctttaacatctagaaagactagatgttgtaaaattaggacttgtttgtcctttatatacactatatacacagataagtaaaataaaatgcacagacataagagacaatggttaatcttgcctcactgtaaacacantgntggcataganctctttgcacttccttctcctgcctcctcccctgaaccagtgcacaaacacaatgtgtaytactcaagaggtggtttggccattcccccaaagacaacatttcatatgaattttaacaaaaagatatttacaaaatgtattattttactacntctactttnaacatatatcaggcacttcagaacatctagaaagactagatatttcaaaaaaatacttagcattgtcaacgatatatacagtagtgaggaataaaatgcacacaaaacaatggttataatatgaaaatgtcttctaartatgaccagtctggnaaagaaccttcttctcttcattctcacgccttctgctccatgkcctctaacccactgaatgaacgtggtsgtgtntgttgctcctggtgtcacttctagagctcgtctaacaatttcgtttcnaaaagtcatttccagaagacatttrttttctankattttttaaaanaaaaaagggcatttacaagacgtgnnattttctaacttyttwacatatagaagggctagatatagcaaanattttctwttaaaargttggggggnaagttgagagcagctttttcatattatatacncgggccttctataaacggtggccagtaaatcttcccaaagggtggtgggcatytccaatgcgccaaatgtggcntgttattcyaccatttctctcttccmacatcaaggtctggtagaasgaaggccaaccgcccgatggccngctaaccdttctacccgtcstygtccgggactcygctcaccttctaggccgtttaaggcctttgtccrtcattnctggcatngtcaggactaggtamggtctcgdccaactgggacagagcggtcagcccgggncccgsrtytgygcrrctccrwggcmtaa

SEQ ID NO: 299 - DNA, 500 bp, Homo sapiens
  repeat_region (1)..(500): mer110
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaaaactgaaaccaacataatttcctgtccctgdgttaaacaatactgggaccaggcatacttttctgttcctatgttaaacaatactgagaccaagcaaaaataacttagctacttgctccaggaaatacytgctcctggaagataagactgtgaaccaactaaaatagcttacttatcaagactaacagcttactcatcaaaactcgtttcaagaccctcgcctcactgtgcccaccaatccaaagctattatgtcataaactctgcccaatcccaaccagttccccgccttgcaagacccaccttaaaatcacccagcccaggccctaaaaccctataaataatcctnccctaatttttccattttgagacactactaagactctgtatctatgtcaaggtgatgttcttccttactgcagtaagtctaataaaaactcagctttgcttgatcaacaggttttnttttctggtggtctttttggggagycgacagt

SEQ ID NO: 300 - DNA, 468 bp, Homo sapiens
  repeat_region (1)..(468): mer110a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagaactgaaaccatctaccacccacacagcttactgactgtctacattaacatgactttactattccactgtcttcatcaacataactttactattccaggaaactcttgcccaggaagataaaagttgcaaataactttattgttcatttcaggaacttcctaaaaaacccatcaactcttcaatagaaagcatcaaacgacagtttatccccaagactctttgaaacccttgcctcaaaaccctcaccttgctgtgtctgtgtccaccaatcctaaactattatatcatgatccttacccaatcctaatcaagcccctacattgaaagacctgccttaaatcagactccaaaatctcaataaatatcctgactttgccctccctcctctgagacactactaagactctgtaaggtggtgctcycccttaccacagtaagcaataaactcagctttgtcttatca

SEQ ID NO: 301 - DNA, 270 bp, Homo sapiens
  repeat_region (1)..(270): mer111
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
atatatcttcagcattttgtacatgttctttaattttattcttttccttcacaattgagcacncagtnaactgaaatataaaatgagactcngattttgntaaanatttatnattttgaccacatctaatnatttctatctttrtcycaattatattagattatsagacctacgcttctttttactagtatcagcacttttattttnatatttwttttccactcatttttaataaataanngrnaaaatgcaataaaataktcatatant

SEQ ID NO: 302 - DNA, 281 bp, Homo sapiens
  repeat_region (1)..(281): mer112
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tccagaccagtggctttcaaactttttttgactatgacccacagtaagaaatacattttacatnatgacccagtacacacatacatatatataactgaaacaaaagtttcataaaacaatacttacccttactatatgtaatgcactctgatattttctattctattctattctattttattttttttaaaaaaaaatgctggttataacccactaaattgatttcataacccactaatttttgggtcacracctgcagtttgaaaaacactgctctagaa

SEQ ID NO: 303 - DNA, 519 bp, Homo sapiens
  repeat_region (1)..(519): mer113
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tttcccaaacttcagtcattttcataccaccttcatgatttttgccatatctatataccacctgtactatttatttacttaatttttctttaaattgactcactttttttatttaaataaatttattttaaaaggaaactttatatcactaccataaatggaaaaccagtatcacttgccataaatagaaggtaaccataaaaataaattacaatgaaaacaaaacaatgttattaaattctagctagatactgttgcctgcctactgcaaggctctgagcctgaggcctgctctctctttgttaaaaagagagattagcaagtgttagagaggtgttaaagacatactaagcaccaaactgagactttctccttgatgtaatcagaaggattgaaagagaattgaaaagggaataactttctcactatgtgattcaatgttatttaatgccatatccatgtnctacctaaaatcatctttaaataccaccagtggtacatatcccacactttgggaaa

SEQ ID NO: 304 - DNA, 648 bp, Homo sapiens
  repeat_region (1)..(648): mer114
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaagttgttnacattttaattgattcttctctawagaccataatatttttaattgagaaaatattctctctataggtgctgaggtacctggtaagctcagagcaaattctactaaatggargatattbtcaattttaattttttttttattgaaatgtgtaaatatttcagcccaaatatttttataggtattatctttttttgtctccattcagaatacctttctttgacaaatatttttacaagacaaaactcatcaaataaattgtctctatttatgattcttttgaatattttaccaaatttagatgctgcaaaattataggccttctcaattttattccattctagtacagaatataaatttatccaattaaaaatagaagctccatcaaaagattcttcccataagttaagatattccaaagtacaattatagaattatagaatttcaaaattaaatcttgtatacacatttgagctctcattatttaatttgttcagttcctcccttgmttttgtaggaataaatttcaatgtctttctgtgtggcaagctttgttttnaataattacaattynctaaaactttaaaaagctgaanttttttgntctctatttattgaanacnttgattaaagatttcca

SEQ ID NO: 305 - DNA, 655 bp, Homo sapiens
  repeat_region (1)..(655): mer115
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aaggctccactctggccctcctccngctncatgcccttccccanggggtaaagagtctgtggggccaaggggatatgcccaccygaaayccatgcccccctttctagaccacgctccaggtacctgggactccagaattccctgtccanatagccccgagcctgcttccagggccttcttccytttccctaggtctgtcctccagagggtggaccgtgccaccagtgtgggcacccctaggcctgagagatggccaaggggtagctgtttgtaggggggttagntgtggacagagcttggacatgcgggctggggtgtccacatacatgcanaggaggccccttatggtgtaggatggagcygggggtgggaagagaagggggagtaggccaggggccaggggctggctctcccccaggcaggctgccatgttctggcatggaactccaaggagtctgagaattctaaatttgaacctggccttccaggtcattatgaaggtatatttgtcaaggtaggagaatagaacatattttaatttaacagtttgttagcttgatttataacttttaaatatttagacatatggtatgtgggcctccatttgtactcttgccctaggccctrcaaatgttaggggtgggcctgggttctg

SEQ ID NO: 306 - DNA, 84 bp, Homo sapiens
  repeat_region (1)..(84): mer116
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tattaggttgaaccatatgaaattgctaatattcgaccatttttgacctacaaaaatggcaatttcatatggttcaacctaata

SEQ ID NO: 307 - DNA, 197 bp, Homo sapiens
  repeat_region (1)..(197): mer117
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagggatggcaaataggtttcatctcatgtgycaactctgatcgattggtagtggctgcctggagtgctgtgttgagaaggattctgaggctgyatctgggctcagtgggaaagagtgctgtgattgattagtgatgtctgccatgggcacaggagggggaagtagcagcanatatgctatgtatttgccatccctg

SEQ ID NO: 308 - DNA, 717 bp, Homo sapiens
  repeat_region (1)..(717): mer118
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ataaaaataaaactattcacaattctagtattcaatatccatctagttgccaatgtaaagaatcagtatcatacttcatgcatgttacatctagacctacatatatacaaatttaagagtaatatgaattgtttaatattgcaaaatgttcctcagctaccatgtgcaactgttgtgaatactgtgctaatttgtgagtacctctggaaccacaaattggaacatgaagagaagcaagaaaatggacacttagcactactgggaaatgatactttgttaagttatgcaagaatctattgcattcatgctatctgaggagaggaaggatttgacaagttaattaatttgttttcttttctcttacctaagtgcttctgctgctcaaatcctccctacactctaaagcagtgtctatctctgacgtcancagcagcggcacaacccacaaaccttcatggcatttggacacagtcacnccttttgttttgaggacanagggcaagagatgtggagaagcatttccctggggcctgaayagtgttagtcacannagagtagatgtttagggttataggttgtgctgtgccagtactgagtaccagatcccaagtgacagaggtacccatgtgttctttatttaataaatgtatgtgtgtttgtgatatgtggggccctctaaagcatggggcccagggcaggggcccctcttgcctgggt

SEQ ID NO: 309 - DNA, 508 bp, Homo sapiens
  repeat_region (1)..(508): mer119
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tagagcagaggttcccaaactttctcagttcatagtgcccttagtgtctcagtaattttttcatagtgcccttaggcagtgtctcagtaattttttcatggcacccctaggccaaaagaaatacctaacagttcyatttattaagtagttaggtccaaacaacttaataagtatttatgtcctaacaacttagtagccatttgaaaaaataatacacataaattgaaagaaaaaaaaaaaatatttttatttcattcttaaataaccacaattacttactaatgggatgtgtgtgcctgttgggcactgcacaacttctcaaaccttggaatcagattggacactgccaccctcatttcctgttccacattgattgnttttcacatagtacttgctttttatcacagcaaccactgaaaacccagcttcacaaagatatgatatcatcaaaaggaatgtagcacacatgatctaatgttgaaactgtgaactacctcaagctagtagt

SEQ ID NO: 310 - DNA, 1126 bp, Homo sapiens
  repeat_region (1)..(1126): mer11a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttgcgggaagtcagggaccccgaatggagggaccggctggagccryggcagaggaacataaattgtgaagatttcattttaatatggacatttatcagttcccaattaatacttttataatttcttatgcctgtctttactgcaatctctgaacataaattgtgaagatttcattttaatatggacatttatcagttcccaaataatacttttataatttcttatgcctgtctttactttaatctcttaatcctgttatcttcgtaagctgaggatgtacgtcacctcaggaccactgtgataattgtgttaactgtacaaattgattgtaaaacatgtgtgtttgaacaatatgaaatcagtgcaccttgaaaaagaacagaataacagcgattttagggaacaagggaagacaaccataaggtctgactgcctgcagggtcgggcaaaatagagccatatttttcttcttgcagagagcctataaatggacgtgcaagtaggraagatatcgctaaattcttttcctagcaaggaatattaataattaataccctgggaaaggaatgcattcctggggggaggtctataaacggccgctctgggaatgtctgtcttatgcagttgagataaggactgaaatacgccctggtctcctgcagtaccctcaggcttactagggtggggaaaaaaccccgccctggtaaatttgtggtcagactggttctctgctctcgaaccctgttttctgttgtttaagatgtttatcaagacaataygtgcaccgctgaacatagacccttatcagtagttctgattttgcccttgtcctgtttcctcagaagcatgtgatctttgttctcctttttgccctttgaagcatgtgatcttgtgacctactccctgttcttacaccccctccccttttgaaatccttaataaaaacttgctggttttgaggctcaggtgggcatcacggtcctaccgatatgtgatgtcaccccyggaggcccagctgtaaaattcctctctttgtactctttctctttatttctcagccrgccgacacttatggaaaatagaaagaacctacgttgaaatattgggggcaggttcccccgata

SEQ ID NO: 311 - DNA, 1096 bp, Homo sapiens
  repeat_region (1)..(1096): mer11b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttgcgggaagtcagggaccccaaacggagggaccggctgaagccatggcagaagaacatggattgtgaagatttcatggacatttattagttccccaaattaatacttttataatttcttatgcctgtctttactgcaatctctaaacataaattgtgaagatttcatggacacttatcacttccccaatcaatacccttgtgatttcctatgcctgtctttactttaatctcttaatcctgtcatcttcrtaagcttcatgagctgaggatgtatgtcgcctcaggaccctgtgatrattgcgttaactgcacaaattgtttgtacagcatgtgtgtttgaacaatatgaaatctgggcaccttgaaaaaagaacaggataacagcaattgttcagggaacaagagagataaccttaaactctgactgccggtgagccrggcrgaacagagccatatttctcttctttcaaaagcaaatgggagaaatatcgctgaattctttttctcagcaaggaacatccctgagaaagagaatgcgyacctaggggtaggyctctgaaatggcccccctgggagtggcctgtcttttatggtngaaactgcagggatgaaataarccccagtctcccatagcgctcccaggcttattaggawgaggaaattcccgcctaataaattttggtcagaccggttgtctgctctcaaaaccctgtctcctgataagatgttatcaatgacaatgcgtgcccgaaacttcattagcaattttaatttcgccccggtcctgtggtcctgtgatctcgccctgcctccayttgccttgtgatattctattaccttgtgaagtacgtgatctctgtgacccacaccctattcgtacactccctccccttttgaaaatccctaataaaaacttgctggtttttgcggcttgtggggcatcacggaacctaccgacatgtgatgtctcccccggatrcccagctttaaaatttctctcttttgtactctgtccctttatttctcaagccagccgacrcttagggaaaatagaaaagaacctacgtgattatcggggcaggttccccgata

SEQ ID NO: 312 - DNA, 1071 bp, Homo sapiens
  repeat_region (1)..(1071): mer11c
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttgcgggaagtcagggaccccaaacggagggaccggctgaagccatgrcagaagaacgtggattgtgaagattttatggacatttattagttccccaaattaatacttttgtaatttcttatgcctgtctttactgcaatctctaaacataaattgtaaagatttcatggacacttatcacttccccaatcaatacccttgtgatttcctatgcctgtctttactttaatctcttaatcctgtcagctgaggaggatgtatatcgcctcaggaccctgtaataattgcattaactgcacaaattgtacagcatgtgtgtttgagcaatatgaaatgtgggcaccttgaaaaaagaacaggataacagcaattgttcagggaataagagagataaccttaaactctgactgccggtgagccaggcagaacagagccatatttctcttctttcaaaagcaaatgggagaaatatcgctgaattctttttctcagcatggaacatccctgagaaagagaatgcgcacctrggggtaggtctctgaactggcccccctgggcgtngcctgtctcttatggtcgagactgcagrggtgaaatagactccagtctcccatagcgctcccaggcttattaggaagaggaaattcccgcctaataaattttggtcagaccggttgatctcaaaaccctgtctcctgataagatgttatcaatgacaatggtgcccgaaacttcattagcaattttaatttcgcctcggtcctgtggtcctgtgatctcgccctgcctccacttgccttgtgatattctattaccytgttaagtacttgatgtctgtcacccacacctattcgcacactccctccccttttgaaaatccctaataaaaacttgctggtttttgtggcttgtggggcatcacggatcctaccaacgtgtgatgtctcccccggatgcccagctttaaaatttctctcttttgtactctgtccctttatttctcaagccagccgacgcttagggaaaatagaaaagaacctacgtgattatcggggcaggtcccccgata

SEQ ID NO: 313 - DNA, 897 bp, Homo sapiens
  repeat_region (1)..(897): mer11d
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtagggagaccccctgaaactattgctacggaataaaagatgaaatgctcctgattattgtaaatacaaaattgcatgcaggattgtgtaaagacaatgccaggttggactgccagaacgagccaacagcgcgtgatgtgcttccccctgcagagagcctatgaatggacgtgcagtcagggaggtttcacatcaccaagattcctatcccagaaaagcagatgttcatagctctgggaatggaatgcgacccttgtggagagcctataaacggacgcatggggggcgcctgtccatatggataagatagggctataaacgccctcatcttgccacggctcttctaggcctctttagggttaaggcatactcccttctgagaatttctggtctaaccggttgtctagcttcacgtcctgtttccatggattgtttgtaaccagcttttgttgcaattgttactgctgattaatatcttgctaatcataggttatggaaagaytgtgtttctgttttaaggctctgttagaaattactgacgcacacactatattgtaaattcttatctctgtatactgtacttctacatacaaatgtactgtacttctacatacaaatgttatgttaaagaattacttcatccccatgtgaccatctcacctcataatcaaatgaccctaaatccctcactaacctacccccgccctcactaaacttaataataaatgctggtatatccagtgcattgttggcaccgtgggaccagaaggcggtgacccccctggacccagctttcactatcttgtgtgtgtctattatttctcaacctgccgatccgcctaggagcaaagagagagccccgttgcattgcgggctgctggccagatcccgcaata

SEQ ID NO: 314 - DNA, 467 bp, Homo sapiens
  repeat_region (1)..(467): mer1a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gctgcacagcaggaggtgagcggcgggcgagtgagcgaagcttcatctgtakttacagccgctccccatcactcgcattaccgcctgagctccacctcctgtcagatcagcggtggcactagattctcataggagcgcgaaccctattgtgaactgcgcatgcgagggatctaggttgcgcgctccttatgagaatctaatgcctgatgatctgtcgctgtctcccatcacccccagatgggaccgtctagttgcaggaaaacaagctcagggctcccactgattctacattatggtgagttgtrtaattatttcattatatattacaatgtaataataatagaaataaagtgcacaataaatgtaatgcacttgaatcatcccgaaaccatcccccccccctggtccgtggaaaaattgtcttccacgaaaccggtccctggtgccaaaaaggttggggaccactg

SEQ ID NO: 315 - DNA, 337 bp, Homo sapiens
  repeat_region (1)..(337): mer1b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggggtccccaacccccgggccgcggaccggtaccggtccgtggcctgttaggaacygggctgcacagcaggaggtgagcggcgggcgagtgagcattaccgcctgagctccgcctcctgtcagatcagcggcggcattagattctcataggagcgcgaaccctattgtgaactgcgcatgcgagggatctaggttgcgcactccttatgagaatctaatgcctgatgatctgaggtggaacagtttcatcccgaaaccatccccgccccccggtccgtggaaaaattgtcttccacgaaaccggtccctggtgccaaaaaggttggggaccactg

SEQ ID NO: 316 - DNA, 345 bp, Homo sapiens
  rerpeat_region (1)..(345): mer2
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagtcggccctccgtatccgtgggttccacatccgtggattcaaccaaccgcggatcgaaaatattcagaaaaaaaattgnatggttgcgtctgtactgaacatgtacagacttttttccttgtcattattccctaaacaatacagtataacaactatttacatagcatttacattgtattaggtattataagtaatctagagatgatttaaagtatacgggaggatgtgcgtaggttatatgcaaatactacgccattttatatcagggacttgagcatccgcggattttggtatccgcggggggtcctggaaccaatcccccacggataccgagggacgactg

SEQ ID NO: 317 - DNA, 218 bp, Homo sapiens
  repeat_region (1)..(218): mer20
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagtggttctcaaccgggggtgattttgccccccaggggacatttggcaatgtctggagacatttttggttgtcacaactggggggggggratgctactggcatctagtgggtagaggccagggatgctgctaaacatcctacaatgcacaggacagcccccacaacaaagaattatccggcccaaaatgtcgatagtgccaaggttgagaaaccctg

SEQ ID NO: 318 - DNA, 798 bp, Homo sapiens
  rerpeat_region (1)..(798): mer20b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagtggttctcaactaggattgtattaccccctaggggacatttggcaatgtctggagacattttttggttgtcacaatgattgggggggrtgctactggcatttagtgggtagaggccagggatgctaaacatcctacaagcantgcacaggacagtcccccacaacaaagaattgtcctgcatcccacatgactttcaaatgtcccactagacattcatgtaggtgaaaaaacctgtttataattatctgagcctagaacctaactctgttttacatataaacacaaagtattttttgcatagttttaatatacactgaattttctaggaatgcaactacvattgtatgtaaattgagggaagattgtactttgttttgtttagaactttaccaaagagttgttcaccattttggaaaatcatatcactaatggncaatactcgctcatggtatttgagttgccaatacaacacacctgtatcagtctgcatttgtagctgtcacattcacggtgattctatngtataggtgcaagcatctgactacttcattatgtcttctagtgtagtcatgcctgagcatttacatattgaaatacatattattttattataaattactttccttttttctcttttatattacagttagagcattatattgattttttttaaaattaatgtgtataggtaggttatattatctatgaatttcatttcaggataaataaaagaggcattacaaaatatttgttataaaaaggggtattgggtctgatagggttgagaaccactg

SEQ ID NO: 319 - DNA, 933 bp, Homo sapiens
  repeat_region (1)..(933): mer21
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gccctyctrttkcagraaaacctctctcaaaccatgttttycctctgctstcataccacgacaacagtcgtcaacacagaagacttctgtgaccaaatgtgtggaggattttccccacacaccaagcagcagacaccagctgggcgtcctccaaytcagttccgacactgtctacctggagatagcgtcagatcccacaggttgaggtctcagtccccaagactgnccccaccttcagayacagttgcaagyccgggyctctggaacttctgaccaactggcttcaarttggggttcccacgacacctctttaggttcgaytaatttgctagagtggytcacaaaactcarrgaaacacttattawgtttactggtttattaatagatgatatttcaaaggatacagatgaagagatacatacggggcggtctggaagrkcccagcgcaggagcttccgtcytgatagrrttggggttacaccctccagattcttcaccttctgtyagcctccacgtgttcagctctccagaagctcyctgaaccctgtcctttgggccttttatggagayctcattggntgtccatgactgaagcatggacgaytgnnawaatgtgattggrcaaaaagggtctgatctaatcccagcaaggyctgtccagattcttcttggtctctttgtgcagcattccttcctccagggtatggggcaggaccycctctggaatgagggtcttacgacccacaatcagattatagagtcctgccttgggcggmtgaaargaggrcargagaaggycagagaratattctgtttcctgaggcctaaagcacctctacattatagcgaaagactgtaaccatggtcatgtgagttatggacaagaaccatggacaaaaacacatatacaatcatatcccacctcccaacgc

SEQ ID NO: 320 - DNA, 795 bp, Homo sapiens
  repeat_region (1)..(795): mer21b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tcaacacacaacacttctgtcaccaaacgtgtggrrrtttttccccacacacaaacaaktcttcagttctgcggcggacaccarctgggtgtcctccaattcarttcagttctgacactawctacctrgagatagcgtcagatcccacaggtttaagggctcagtcccacaagactgcccccacttcagatrccagtcgcaagtctrggttktcacccgtacttctgaccaactggctataaattgttcccacgacccctctttaggttcgattaatttgctagaatrgctcacaraactcagggaaacacttatatttaycggtttattataaaggatattacaaaggatacagatgaacaaccagatgaagagatrcatagggcgaggtmtgggagagtccngggnncaggagcttccgtgccctctctggstnnrccaccttccwggcacctccacgtgttcaccaacccggaagctctccgaaccctgtccttttgggtttttatggaggcttcattacgtaggcatgaytgattacatcantggccattgattatcaactcaacctycagcycctctccyctccccagaggttggagggtggggctgaaagttccaaccytctaatctgccttggtctttctrgcgaccagcycccatccwgragcntnctaggggctgcccrccakgagtcgmctcattagmacaaaagrncrtynctattacccaggarattccaagggttttaggagytctgtgtcaggaaccggggtcaaagaccaaatattagat

SEQ ID NO: 321 - DNA, 1503 bp, Homo sapiens
  repeat_region (1)..(1503): mer22
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gtgatggctgcacgctcggtccaggaagaggcggaggaagcccaccgctcctgacattggccttctaggaaaggcggtgttgcatcccacctgcacttcctctctgattcttgagggccaaccgcttcctccgctcctggggaaagtgccttctagcaccgaatcttttggctgccacggatgtcagggagccaacgggactgggttttggctgggtgcaggggaggttgcgtcaggggtactagccggcggcgggctgggggtggggtgtactttgtccaaactcccggctcctctggcgggcctccctgaacgtggcgtggactcgcgcacaggccctgtctcgcaggttttcaggtgcgcttggcttttcctccgctttgtggggcaggtctccagtgcccccggcgcacgcctggacatcactgtccgtctcgtcgtcgcccctacggcctcaaagacacacgctgcctgcatgtgctcttgggggacgacagtgcacatgtggacacactggctccagctcggactcgcctctgtctctctttgcccgtgtcgccggaagccgcctcgggttgccggagccctcgggccttggagatgaaggcaggcccctgctcctgccaggaaggagggaggcagtgggctcatgggtcggtgcctttgcagccgacagcacgtgcggccctggggatcttcctgtgccccggcgagaccctttccgcctcactgcattggaaccccattcccgatcacccgctgggatccatcatcggactccaagaggagtccgcgcagccagccggcaccccgaagctcctccttcagcgggaaccgaagcagaagagcgatcaaggaggtcctcaccacaggactcctatgggtccgaccctgggtctcccgcaggcccctctggcagtcctcttcccacccgccgcctcggcttcgccgccgccgccgcaacctccagcaccgccccccaggccccgcagccgccgtcgccgccattttttaaagggtcgcagcctgactctgcggagtaagggggggtggagcgggggagtcgctcgccagcatgcgcgagcccgagccgccgcttgggtcacagtgaaagccaccgttgcccggggatgggtccctgacacttggggaagtaggagccctgtgtgatcgtgcgtctgagtctgggctgagaccagtcctggccagggcagttaccaggacggtctcggaggccgggattcgcggagggtccagcagcaggaagaaaccccaggaggaagaaacctcagacagatcgccggcgaggcagcgcgggatcccagcctcaggcgtgcgcggacggtgtgcgggtgagtctccccaaaagtggagcccttgtgatgacgagcacaggtccgcctgcgtgcccgtgggcggctctctcaccggtggctctcagtcgcggagagcagaacccgcagcttcaggggctgctgcgggagggtgttccctgctgtacgt

SEQ ID NO: 322 - DNA, 434 bp, Homo sapiens
  repeat_region (1)..(434): mer28
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagttgacccttgaacaacatgggtttgaactgcgtggrtccacttatacgcggattttcttccatctctgccaccctgagacagcaagaccaacccctcctcctcctcagcctactcaacntgaagacgangaggatgaagacctttatgatgatccacttccacttaatgaatagtaaatatattttctcttccttatgattttcttaataacattttcttttctctagcttactttattgtaagaatacggtatataatacatataacatacaaaatatgtgttaatcgactgtttatgttatcggtaaggcttccagtcaacagtaggctattagtagttaagttttkggggagtcaaaagttatacgtggatttttnactgcgcggggggtcagcgcccctaacccccgcgttgttcaagggtcaactg

SEQ ID NO: 323 - DNA, 209 bp, Homo sapiens
  repeat_region (1)..(209): mer3
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagcgctgtccaatagaactttctgtggtgatggaaatgttctatatctgcgctgtccaatacggtagccactagccacatgtggctaytgagcacttgaaatgtggytagtgcgactgaggaactgaatttttaattttatttaattttaattaatttaaatttaaatagccacatgtggctagtggctaccatattggacagcgcag

SEQ ID NO: 324 - DNA, 230 bp, Homo sapiens
  repeat_region (1)..(230): mer30
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggggtgtccaatcttttggcttccctgggccacactggaagaagaagaattgtcttgggccacacataaaatacactaacactaacgatagctgatgagctwaaaaaaaaaaaamaatcccamaaaaatctcataatgttttaagaaagtttacgaatttgtgttgggccgcattcaaagccatcctgggccgcgtgcggcccgcgggccgcgggttggacaagcttg

SEQ ID NO: 325 - DNA, 190 bp, Homo sapiens
  repeat_region (1)..(190): mer30b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cacgggtgtccaatcttttggcttccctgggccacattggaagaagaattgtcttgggccacacataaaatacactaacactaacgatagctgatgagctaaaaaaaaaaggtctgtgcataattttcgtgatatccaccaccacagataagcaaaaaagtccttgcattcaaagggttggacaccgctg

SEQ ID NO: 326 - DNA, 483 bp, Homo sapiens
  repeat_region (1)..(483): mer31
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tggtgacaaagactctctccttgaccaaactttagtcaggctcctctgagccctcttctcaactaagccccgaccttgggcyctgtccttggcctgcwnagtccagttttagcaagaatcctgctaagtcagtttagagagaatcccccaccctcgatatctgatcaggttcctcatcctccgccatcccccaggcgatgtctgatcaccctggcctgccttcagcaagaatcctgttaggtcagtttagcmagaatccccctacccctgatgtytcctcttagtaattttccatccactgacccccaccctgctccttggctataaatccccacttgtccttgctgtattcggagttgagcccaatctctctcccctactgcaaaatcccattgcagtggtccctgtacctatcgcaatggtcctgaataaagtctgccttaccgtgctttaacaagtgtcgttgaataattttctctgaca

SEQ ID NO: 327 - DNA, 485 bp, Homo sapiens
  repeat_region (1)..(485): mer31a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgacaaagattctctgcttgaccaaactttagtcaggctcctgaaccttctcctaggcccatctgtgcacttccttgtaaaatccagttttagcaaagaaccctgctaagtcagtttagcmagaaccccccacccttgatatctgatcaccctcaatatctgatcgggttcctcatcctccaccatcccccaggtgatgtctgatcaccctggcctgtcttcagcaagaatcctgttaggtcggtttagccagaatccccctacccctgatgtttcctcttagtaattttccatccactgacccctcaccctgctccttggctataaattcccacttgcccatgctgtattcggagttgagcccaatctctctcccccactgcaaaatcccattgcagtggtccctgtacctatcgcaatggtcctgaataaagtcttccttaccatgctttaacaagtatcattgaataattttttctttaaca

SEQ ID NO: 328 - DNA, 466 bp, Homo sapiens
  repeat_region (1)..(466): mer31b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgacaaagactctctccttgaccaaactttagtcaggctcctctgagccctcttctcaactaggcctcgnccttgggccctgtccttggcctgcwtagcccagttttagcaagaatcctgctaagtcagtttagcgagaatcccccacccttgatatctgatcaaattcctcatcctccaccatcccccaggtgatgtctgatcaccttggcctgccttcagcaagaatcctgttaggtcggtttagcaagaatccccctacccttgatgtctcctcttagtaattttccatccactgacccctcactctgctccttggctataaatccccacttgtccttgctgtattcggagttgagcccaatctctctcccctattgcagtggtctttncacctattgcaatagtcctgaataaagtctgccttaccattttaacwagtgtctgaataattttttctttaaca

SEQ ID NO: 329 - DNA, 4936 bp, Homo sapiens
  repeat_region (1)..(4936): mer31i
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gttgtggtgccacaggcctctgacccagaacctgaagtatgcacctttgaaacctttgtcttcactcttggctgactgatcgggaatccattggtaagcccaactcttgagccagtgctccagatggcagtctgttgaagcatggtgaggatacattttgattcttaaggtccaggcttcttttgaaaggtannatacctcctgggctggaagwttttcctcctggctctttgtttcgagtggggattcactccctgactcctgggctggmagtctttttttggccctctgtgaggcctctctgttctctctatctgatccttctcctcccataggaacttctcagtcgactgaaacccctttctcgaacccctgcwgactatatgctccgccaactctgtccacctccttccttgttggcacgattttgctgaggataatttggaacttcagtggcctctttgggaaacttgagatctccccaaactggctcctctaagacctctcccttcccattgcctctgctcctccttctgccaccttcgatcttctcttcagtttccttgaatcctttgatatgtcccccttcaagcccctacctcctccacccctctatccacccctgccagacctttyccttctcactccagcccctcaactccctatagtcattagagctttaggcctcctgccmcawcagggggcgckcgaggggctcagggacacccaaaagcaaccacccgaggctgaaaaggctarctggaaacagactggatattttatccactcagatggactttggagacatccagacgtccgcttggtgtctcctcagtccctcacctaaaatttagtccacagcctctatcggattacacatcagggcaaagaaaatcttaaaggtctcctccacaaatattsgtrgaaagctttagccctcatgttgagyaggtaacctcaacttgtcccatctgccagaaacacaattcagataaaaatataaagtggggcaaagataatgagccaactctcttatattaaccagtgagttttgtattwctgtgtttatgcctgattcatggctaaaattttagaatkaaagctgtaagatctctatttgtatctgtctgtatgtttatgtatgtatgttatgtatatgtgatatttttctacctccagatggtattaccaaattaatttataaaatcccttaaggagctctattcaaantgacttagagataaatgagacttatataaattaaatattcctaaaactcccagaaatatarraactaacccaaatgcttttcaatttcacatgatttgggtaaatctttggcaaataaaattagtttaatattgttggtttaattaaaaaagggtatgtcttctgagttatcagcattaaatataatacaagcatacatatttattctacytgggtttagcagtatgttatctctactaaatatttaaagttataaaaattataaatttaacctaagaatgaatgaagaagtgcagtatccatcacttcatgcatatcaagcagagcagttaaacaaaacccatgtatttaacatttttaggtttttgttttgttgatgcttgcctaacatgaacatgctataaaattagttaacagaaaaataacttgaagtgatgttttagccttgtatgatgttataatatnatagcctaaaaacagtttccaaatatttggtgatgtgaaaccttagagttatgctaagttaaattaagtaatagatattcattaaataactagatcatttctaaggaagataaactactaaaacactactaaatctaagtttatgtttatatactttttggttcttatttttatatggtacagagaggctaaaatatattcgagcctcttaataaacatgaaaaattgtattataaaaagtagnntatacctntaaaaattatgagatggtatattcataaaatttgctaatgtgcacatacagaatcctggtatatgacagacagttcacaattgcctacttcccagtttttttctgtaaaagaaaagttattgatggttaaaaaatattatctatctatctatatatataattaaaactactagaaacaataagactgagggaaacaactttgtatgcaaaatatgcnagggtagtaggttagatttttaataaagtatataaaatatgaaaaatgtgttttcgttaaggaaaaaaagagtaattttgtcctaaagtaaaatgagtgattgttcaaaatgagaaaggggaaaagtgtaggactaaagctaaatanatattttttaaaagttgtaaaagttgtggaaaaggaattttatgtgtagtcaagatgctaatntatttataaggattttttaagctcaawtantgtactaatncanaactataatttggtttccgctctgttgaaaggacaaagttttcttaaantattgtaaaagatttttctttaccttttnaataattnacctaggaagcaaagattttgtgtcttatcaagataaattccctgtgcttcatgttgtctttatcatatntttaattacttttgaaagcaaatcttttcaattttaaaaaagctagggttatttttctcgagtatgttacttcctatatttacctctggaatcttttattgccactttgattaaatggataaccaagtatatttcatagcgacccgtaatcctatttaatcaagcgttcaaaccttttgacatttttgacaaacttcccaaaatcacaattttaaatgaagtctttttgacctccaacctaactttganattttccggagggcctctgaaaaatctctaaagaacttgttctttcaccttgtaaaagagagatattaaactaattaggcttatttcatatgttaaattacatgggaagcattgtcaaataagaaatggtgcttaaccttctttgagttatatttgtatgggtacctgttattaatataagtgttccagaaattgtatgaggttcctaaaaatttgtcaatacccttgctcttnatgatatgtccagcataattatgttatcagtcataattgcagttattatgttaaaatgytgtatgccacagaamtaaccaaatttgcttgtcaagtgaactctcatcagatctttaaccatgactattttaagtcttttgtcactcacagacagtttttgttttactctgattcttctctgaaagcatcttacaakcagctacagggcaaagtgcttcatcttcaaagaagctcatgagaaagacaggtactctgaaatataaacctctgatactttgcagaccatgccactggactgagtaagaatttccagacttgaatgaagaaactgacgggttcatgaaactgctaacccaagatcaagcagaacaagaattaattacatgggactgaatnaaccgatgaggatgatttatagttttttatgttttttgtttgaaacattgctggttctttaatgttttgttttccagattcaaggaaactttttcttttcttttaagctatctataacttacagcaatttggtaaagtatacttttgtgaacaaaawtgaaacaattacttttctctctacctgatccctccagaattcggaaactattagtgagtattcttattttcatggcaatatagttatttgcataagttcagtaagaatctgttctccttgtaacaggacacaattggaaacactggttatattaccaaggctttgactagaatgtcatatttgggaatgatgggcatagaattagctttaaggaactaaagttgactttatggaaccaatgcttacaaagccctcttggaaaaatcggcctggtacctggcttacasggttcccggccttncaggtgagtaaggaaagtcactttctggcaggcccaaggacctcaggatattttggggacctcaagaagagaggaattcacccaaatctatagatattgcaggtgaagtctgatggcgaaatccttggcttggcttcatagccttgagaagcttttaaaagnccaatctgagattccttattaaaagttccagcaaagcaaaccttaaaagagcctatgtggtcagtcactattcttgctgcatttatgtaaataatcaggccaagtctaatgagatcagacttattttgcaaacaagttagtcttactntgattatctttggtaaaaaggggagtgaggtgactatagagagaaattttatgtttcagtggaaaactatagcgcacccattatcagattctagtcctgttcattgtttttggttttattatctacctgcaaactggactggatcctgaatttttctagttttctccaatatctggctacaactctccaaactaatgtttccaatttttctcccacccttctggcttggaatcactgaaaattaaaactgcccttttcctgaagccctgcaagctgaaactggacgacttgatataaacttcagagaaatcaccacaacagatcatgtgtgggcagccttcatgacacccaaactgcaaaccaggaaagcctgccagctgccactgcctacctcactccagctgaagatgcttcaagcccagcatctagaaatcttattgaccggctgccctctggactcagaaactgagtttccaantgttaacctttgtttttattttattttcatagaaactaaactcccctcattaaaggcctgatggctcacaccatccagsaaatatcctctgctaccaagtcccagcagatgattcagctggtccttaatgaacaaaaggcmacccaacaagaaaatggacttatattgttcaaaggaaagaagaatgtctcttctttccttraacaagaggagggactgacaaagattctctgcttg

SEQ ID NO: 330 - DNA, 324 bp, Homo sapiens
  repeat_region (1)..(324): mer33
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ctgcgctgtccaatacggtagccactagccacatgtggctattgagcacttgaaatgtggctagtccaaattgagatrtgctgtaagtrtaaaatatacaccagatttcaaagacttagtacgaaaaaaagaatgtaaaatatctcattaataatttttatattgattacatgttraaatgataatattttggatatattrggttaaataaaatatattattaaaattaatttcacctgtttctttttacttttattaatgtggctactagaaaatttaaaattacatatgtggctcgcattrtatttctattggacaacgctg

SEQ ID NO: 331 - DNA, 546 bp, Homo sapiens
  repeat_region (1)..(546): mer34
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tawtgaaggagatcagaatatgccaccccaaaatatgccactttggcataaggattattttgagctaaaggcacttgagaaacagcagrtgcaagaagagcactctgaccttcctcttttcttcctgaaagcaggagataaaactcccatgtgaaagacgttctctctataccaggaggaaggaaacattcttatcgtcagagacggggagtcgaggccgagggaaatctgtacgaacaaaccttgttaaactaacyctyatcttcctagtcacttctccacgatgaaccgccctagcccaaacccctttgtcttgtcacgttttcacaatttactactctttgtccaacctagtatawaagcgttcgactctaaccgcttctttgggtcttcatttccttatgagggctcccatgtacatgtaaaacatacttaaataaatttgtatgcttttctcctgttaatctgtcttatgtcagtttaattatcgggcccagccggaaactctaagagggtagaggwaaaatttttccttcyctnccatgg

SEQ ID NO: 332 - DNA, 1351 bp, Homo sapiens
  repeat_region (1)..(1351): 11mc5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aaaaaaaaaayacatttctascctttccactgaaaagncctagaaacaatgactaatccaatagcaatgagtaccctyaggacccagattgtggtctctaaataccatttcccactaaaaggaaccagggctccttggagaaatggctaattccaggtctggggcaggaaatgtacaagatgagcctggaacatcttgtcataccagatagcaaggaagctataaaactactagggttgtgtcaaaaggactcaggagccaacttactggccaaagatgggacaatttgagcatcaataataactgcaatttaacacatcaaatatrtttaaatccatgagtttataataaaaaaatctaattggtcacctttggagtgatgctagggaaccaactcattattttgaaaactggtaaataaagggaaagaatcaagcatttatcttgcctttcctatataaactgtacctcwgggtaaccaaatagtwgatgagggaaatttctctttatagaagtattccagctaataaatgaagaaaaaattagaattagaatatcaccattttgcaacccctaatgaattaatggatctaggcaatgatcatcaatggctgctaacatcacaaaaactarasatytgcctcctgatggaartawacaacaccacctatgaaatattagtcttgccaaaaaaaaatcaaacctgaatctgatcaagcctctagatctaactaccaatttacaggaaatacagaggacagaggaacatgttaaatgacaccatrgggatgcaatcagcaaaatccagactgtgggaaactctacaggacaaatrttaacttttcttcaacaaataaattatgagaaaaaaaagatggaagaagaacctatagattaaaagagacttaaaagacatatcaaccaattacaatgtatggaccttatttggatcctgattcaaamaaatrtaaactataaaaatatatrtgtatacaattggaaatttgaacactgactagatatttgatgatattaaggaattattgttatttttaggtgtgataatggtattatagttattttataaaatagtccttatcttttagagatacatactgaaatatttatagataaaatkatatgatgtctgggatttgcttcaaaataatccaggagggaggaagtaggtggagctatagatgaaacaaaattggccatgaattgataattgttgaagctgggtgatgggtatgtggaagttcattatactattctctctacttttgtatatttgaaatttttctaatwttaaaaataaagaccaatttgttggacattaatttgttggcaa

SEQ ID NO: 333 - DNA, 1095 bp, Homo sapiens
  repeat_region (1)..(1095): l1mca_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttaakatagngaatnttcttcaaaatnnatanntanaaaacgataacaggacttctagtttccggtcccgcatgtaaggagcttgaaagttgccactccatcctaacaacaagtaaaaagctgaacaaactgaaaaatcaacaactcttcttagatccgtaagagaagtgaggtcatagggcaaaccactgcccccagaattggagagacaaacaggtgaatacagagaatcacaacttaccggagcagaaactcataagcagaaacctctgtgggaaccagtaccggggtaggaaaacctgaactgtaattgacaaattgctggaggctcagtgtggacaagtctgagagttgaaaactccaggggancccagtcattaggtgacccccacacttttgtgagttttacctccaggagcytgaccaggttctcacagtgaatatcggagaaaaatccccttgtgcttccggcaagaggagaggaaaaggaacaattctgaaatataccasagcattctgttcttttaacaaagtcctgccctcaggagaaactatttaaccagagcctaacctgttagagttttwtcagagcctaaccgacctgggggaagggaaatacccaactccagccccctctagccatcctgtcccacctaaagggagaaaaaaagctaagaaacacttgtgaagttcacagyccaggngcacaggctcactaaaagactgagaactaatcataggactatagaacacttccctcccccncataccttaccaccacattactaaaagcctatttacaacagttccttttacccagtacatcatgtccggctttcaacaaaaaattacaaggcatactaaaaggcaaaaaaaaaaaacacagtttgaagagacagagcaagcatcagaaccagactcagatatgacagggatgttggaattatcagactgggaatttaaaataactatgattaatacgctaagggctctaatggaaaaagtggacaacatgcaagaacagatgagtaatgtaagcagagagatggaaactctaagagaagaatcaaaagaaaacgctagaaatcaaaacat

SEQ ID NO: 334 - DNA, 1197 bp, Homo sapiens
  repeat_region (1)..(1197): l1mcb_5
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgacatgtaangagcttggaagttggcactcccttcaacaacaacaaaaagntgaacaaacagaaaaatcaatgacttttcttagatccataagagaagtgaggtcacagggcaaactgtcancctgaaatctggagagacaggcgcatgcagagaatcacagcagagctctgctttcctgaagcagaagcctctgggagcacaagctggtaggaaaacttaaatggtaattttggcaaattgctagaggctgagtgtggactagtttgagagtaagaaattctcggnggcccagtctaggggaacctccacactttcgtgggctttacctccaggagtcccactagtttctcacagtgaagatccgagaaanttcgcttcacggctctggcagggggaggggaaaagcaatcattktgaaatacgcccagagtattctccgtaacaaactcttgccctacaggagaaaatactttgccagagccttatcctagctttagggaagggtaatcacccaactccagccccctctagccttcctgtctcacctaaagggagaaaaaaagctaagaaacacttgtgaaggtcacagcccagggactcaggcccactaaaagactgagatttaatcataggattatagaacgtttcccttccccmataccttaccaccacatcaacagggctccagtataataacaatggattacagctgaaagaactgcaaaacmcagactctatttaagaaggagctnctagggaaacccaaagacaggagaggagacaaaaacaaggacaccggagtraagtttagcctctgacacctacagctacagcaaacagtaaacacagtctaactcttagccagataaacataaaacctcacattaaaggcctatttacttcagttccttttacccagtacatcatgtccggctttcaacaaaaaattacaaggcatactaaaaggcaaaaaaaaaaaacacagtttgaagagacagagcaagcatcagaaccagactcagatatgacagggatgttggaattatcagactgggaatttaaaataactatgattaatacgctaagggctctaatggaaaaagtggacaacatgcaagaacagatgagtaatgtaagcagagagatggaaactctaagagaagaatcaaaagaaaacgctagaaatcaaaacat

SEQ ID NO: 335 - DNA, 1536 bp, Homo sapiens
  repeat_region (1)..(1536): l1mcc_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aggaacttccactttcagttctacttccacttaggatgtagaaagccacaaragaatattgctcccatcctaacaatragaaaaaaagccagataatctacaaaatyatacttttcttgagcccatcagagagctgaggtcacaaggcaaccaagtaaactgaattccaaagagtgacaagcccctccaaggagaracaggacacaygaactgtttcacctttggcagagcataggaggaagaggtggccaccataaaagcaggtaagaagaaatcagctaaaattttaataaattcttaaaggccaagtgtgggctagtgtgwcagtttagaaagctgggagccccagacacaagggaagtttgcactcacttgcaagctcttttccatgggcctccaccaggtgctcatgagaaagactgggggcagggcaggagactgaagaaagccctcctcagkggcacaggcatgcaggaggtgatcggctgcngctgggggacaggaacgaagccnncctcatnttcncagaactttcttyccyaaagcaaaagccttnngctrctgggntgasaggnagcaaacccnnttnctcccagggcckwrgcaaaracactmtwsyttytysrgaagmggtargagcyaaaccwtctgattctgggggaagaacagaagcaaaagccttctscycnygngraagggcagrraacwntntyaggyncaggatnntgcantgatacaaancagaggtcwgctactactgggagaggnacaggtcccatcccaaccacagatacaaggagagtttgactgccatggagagaggggcaggaacactgagaaagccccactcctgaggcccaggcgcacagggcctgcctaagactgaggctggaccaggacaacagagaacatccctnctcccaccacaagcctaacaagcaccaagtaacamagcaacagcagtctaccactgggggagggnnannannatggagagagactccctctgtggcacaggtatgcagggactactgaaagctgagggtggagcaggaacactgagaaaaaccctctagcaaaccagcccccacactaagcacaaggtaacagcagcccaccactagaggaatttgaagcctgtggtgcactgarggtaaccatagcaacaacaaaacccaaacccagctcaactcctgactagattgactcaacccccacactaaaagcctagcagaagaaaaggcatgcccatttccaggcataaatactatttacctcagtctctactgttcttctacacataatgtctrgcattcaataaaaaattacaagacananaaaaaaagnaaaaaaaaacaacccattgtcaagagacaaagcaatcaacagaaccagactcagatatgacacagatgttggaattatcagacaaagaatttaaaataactatgattaatatgttaaaggatctaatggaaaaanggtagacaacatgcaagaacagatgggtaatttcagcagagagatggaaactat

SEQ ID NO: 336 - DNA, 971 bp, Homo sapiens
  repeat_region (1)..(971): l1md1
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cttgtatccagaatatataaagaactctcaaaactcaacaataaaaaaacaaacaatctaattaaaaaatgggcaaaagacatgaagagacatttcaccaaagaagatatacaaatggcaaataagcacatgaaaagatgttcaacatcattagctattagggaaatgcaaattaaaaccacaatgagatatcactacacacctattagaatggctaaaataaaaaataatgacaayaccaaatgctggcgaggatgtggagaaactggatcactcatacattgctggtgggaatgtaaaatggtacagccactctggaaaatactttggcagtttcttataaagctaaacatacamttaccatatgactcagcaattayactcctaggtatttatcccagagaaatgaaaacttatgttcacacaaaaacttgtacacgaatgttyatagcagctttattcataatagccmaaaactggaaacaacccagatgtccttcaacgggtgaatggttaaacaaactgtggtatatccataccatggaatactactcagccataaaaaggaatgaactattgatacatgcaacaacctggatgaatctccagaaaattatgctgagtgaaaaaagccagtctcaaaaggttacatactgtatgattccatttacataacattcttgaaatgacaaaattwtagarwtgragarcagattcctggttgccaggggttagggacgggggtgggggtggagggaggtgggcatsstggagttccctgtggtgatggaaatgttctgtatcttcactgtatcaatgtcaatatcctggttgtgataytgtactatagttttgtaagatgttaccattgggggaagctggatgaagggtacacgggatccctctgtattatttcttacaattgtntgtgagtgtgtaattatttcaaaataaaaagtttaatttaaaaa

SEQ ID NO: 337 - DNA, 1088 bp, Homo sapiens
  repeat_region (1)..(1088): l1md2
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cttgtatccagaatatataaagaactctcaaaactcaacaataaaaaaacaaacaatctaattaaaaaatgggcaaaagacatgaagagacatttcaccaaagaagatatacaaatggcaaataagcacatgaaaagatgttcaacatcattagctattagggaaatgcaaattaaaaccacaatgagatatcactacacacctattagaatggctaaaataaaaaataatgacaayaccaaatgctggcgaggatgtggagaaactggatcactcatacattgctggtgggaatgtaaaatggtacagccactctggaaaatagtttggcagtttcttataaagttaaacatacamttaccatatgacccagcaattayactcctaggtatttatcccagagaaatgaaaacttatgttcacacaaaaacttgtacacgaatgttyatagcagctttattcataatagccmaaaactggaaacaacccagatgtccttcaacgggtgaatggttaaacaaactgtggtatatccatacmatggaatactattcagccataaaaaggaatgaactattgatacatgcaacaacctggatgaatctcaagaacattatgctgagtgaaaaaagccagtctcaaaaggttacatactgtatgattccatttatatarcattcttgaaacgacaaaactatagagatggagaacagattagtgrttgccaggkgttagggatrcaggraggaggtggatgtgrytataaarrggtagcatgagrgaatytttatggtgatggaacwgttctgtatcttgaytgtggtgrtggttacacgaatntatacatgtgataaaattgcatagaactaaatayryryryrataagtacaagtaaaactggcgaaatctgaataagatwnatggrttgtaycaatgtcaatwtcctggttktgatattgtaytatagttttccaagatgttaccattgggggaagctaggtgaagaacacacgggatcccyctgtattatttcttacaattgtntgtgagtktayaattatttcaaaataaaaagtttaatttaaaaa

SEQ ID NO: 338 - DNA, 1604 bp, Homo sapiens
  repeat_region (1)..(1604): l1md_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttaaaaacaaagcgggagacttccgcttccgggaagatggagtagacgtacttttccctattcctcccgctaagtacaactaaaaaccctggacattatatataaaacaaacataagaagactctgaaaggtggagagaagaaggcagaccggctagggacctcgggacccgaggaacgacacggtagtgagttccctgggttttctttttgcctcatatatcccagacttggagctgaagaagccggcaacccggaaacgccaacgggcacagacaaaaaaagccccaacaaaagcctgctctctctagccaaaggaccaggaaaggggcagcctagcaagacagaaaacttttagacaataaccgctctactccagccaaacaccacagaaaaaactgtggccccacccccacccacgccagcaaaggccgagtggggagcctagacttccaccctcaccaggctgtaacgaggcgccccaacacctccaccgggatggtgtcagagaaggccaagtagggagctgggactttcatccccgccaggcggtaatgaggcccmccttccccttgccmctgcggtgtcagtggagaccacgtggggagcctggacttccacccccacccggcagtaatgaggcgcccctccccctccctactggggtggtgtcagaggaggcctagtggagagtcgggactttcaccaccgcccagcggtaatgaagccacctcctcctcttgccmccatggtgtcagtggaggccacgtggggagcagtaatgaggcactcctacccctcccagccagggaggtatcagcggaggcctagtggggagccgaactcccacccccgcccagcagtaacgaggagcccctccctcacctcgggtgtcaacggaggccgagtggggaacctggacttctacccccacctggcagtaatgaggcagcgcccctncccctcycctgccggagcggtgtcagaggaagccggctaaaacagaaggtttaaataagatccagagtctcataacataatacccaaaatgtccaggtttcaatcgaaaatcactcgtcataccaagaaccaggaaratctcaaactgaatgagaaaagacaatcaatagacgccaacaccgagatgacagagatgttagaattatctgacaaagattttaaagcagccatcataaaaaatgcttcaataagcaattacgaacgtgcttgaaacaagaraaaagtagaaagcctcagcaaagaaatagaaagtctcagcaaagaaatagaagatataaagaagaaccaaatggaaattttagaactgaaaaatacaataaccgaaataaaaanctcaatgratgggctcaatagcagaatggaggggacagaggaaagaaccagtgaacttgaagatagagcaacagaaattacccattctgaacaatagagagaaaatagattggaaaaaaaaatggacagagcctcagggacctgtgggactataacaaaagatctaacattcgtgtcatcggagtcccagaggagaggaaaaagagrrtagtatttgaagaaataatggctgaaaatttcccaaatttggca

SEQ ID NO: 339 - DNA, 503 bp, Homo sapiens
  repeat_region (1)..(503): l1mde_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gaagtactctccttccccaccaggcctgagactcctcccctaccaagagataccaaggtgaccaggtggcaccagcaagagggatcctgccacaacaagcagcctggnnnancctggaagcactctctttccccatgggcctgagactcccctcccctacccagagacaccaggtatgcyaggcagcactagcaagggggatcctgccacaacaagcacctagcccaggaagcctctttatccccatgggcctgggagactcccttccncacccacatcccctcccctnnccccacctagagacaccaggcagcctggcctggggaagctccttctgccccctcaggcagcaccagcagggaccagtgggagccccagtagcaccagataaaccaagcagaccaaaatagcactgcaaaggctctgaaaattaaactgtcattggaaccacagcccacaaaaggtaggccaggacctacatgctaaacctaaacagggtgact

SEQ ID NO: 340 - DNA, 1089 bp, Homo sapiens
  repeat_region (1)..(1089): l1me1b_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagacttccgcttccggtaatggtggagtaagctcctaccggaccaaccctcccgcagataacaactataaactctggacaaaatacaaaaaacaactacttgaaggcactggagagtgaccaaaagcaggcagaaactggaggggagtcgacacctggaagaagggaatwgcacggagtgagttcccatttctacggctttttgcctgagagcaggccgcagttggtgcgtcgtacagatggctaaaacwtcagtagaaaacccgcggtcttactggcttgaagaaccagagaanagaattcggggcaaccacagccactggaaagtgaggggaaaatcccggaaaggagagagccagagagaggatccccaaattctgtgtataaactctgcccaaatctctggctgacccctgaaccacgcatgcgcggagcagactccaagcagcccagctaaagacaaaagaactgaactgagattggagctgccgcccaagaaacagagtttgcagttcgagtccagccaagytaactgcctactaaaacaaaagaaacaacactctttagagaaaaataacagaatccagagtctccacaatktaacattcatgatgtccaggatacaatcccaaaattatacmagataagaagaaacagraaaaatgtaatncatccttaagagaaaagaaaataaaaaccgaccctgagatraaccagatgttggaattaacagacaaggactttaaagcarctattataaatatnttcaatgaaataaaacaaaatatgctcacaatgaataaaaggataggaaatctcagcagagaaatagaaacgataaaaagaaccaaatggaaattctagaamtgaaaaatataatatctgaaacaaaaaattcactgaatagacttaacagcagaatggagatgacagaggaaagagtcagtgaacttaaagatagatcaatagaagttatacaatctgaagagcagagagaaaaawnatttawaaaaaaagwgmakagtctcacaaacatgtgcgacaatatcaaaaggtcnaacatanatgtaattggaatcmcagaaggag

SEQ ID NO: 341 - DNA, 911 bp, Homo sapiens
  repeat_region (1)..(911): l1me2
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cttgtatccagaatatataaagaacgcctacaactcaacaataaaaaaacaaacaacctaattaaaaaatgggcaaaagacttgaataggcatttcaccaaagaagatatacagatggccaataagcacatgaaaagatgctcaacatcattagtcatcagggaaatgcaaattaaaaccacaatgagataccacttcacacccactagaatggctaaaattaaaaagaccgacaayaacaagtaytggcgaggatgtggagcaactrraactcycatacattgctggtgggaatgtaaaatggtacaaccactttggaaaayagtttggcagtttctcaaaaagttaaacacgcacctaccctatgacccagcaattccactcctaggtatttacccaagagaaatgaaaacatatgtccacacaaagacttgtacaagaatgttcatagcagctttattcataatagccmmaaagtggaaacaacccaaatgtccatcaacaggagaatgaataaacaaattgtggtatatccatacaatggaatattactcagcaataaaaaggaatgaactaytgatacacgcaacaacatgaacgaatctcgaaaacattatgttgagcgaaagaagccagacacaaaagantacatactgtatgattccatttatatraaattcwagaacaggcaaaactaatctataatgntagaaatcagaatagtggttgcctctggkgagggtraatgactggraagggrcatgagggaattttctggggtgatggaaatgttctatatcttgatcggggtggtggttacacgagtgtatacatttgtcaaaactcatcgaactgtacacttaaaatctgtgcattttactgtatgtaaattatayctcaattttaaaaaa

SEQ ID NO: 342 - DNA, 909 bp, Homo sapiens
  repeat_region (1)..(909): l1me3a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cttgtatccagaatatataaagaacgcctacaactcaacaataaaaaaacaaacaacctaattaaaaaatgggcaaaagacttgaataggcatttcaccaaagaagatatacagatggccaataagcacatgaaaagatgctcaacatcattagtcatcagggaaatgcaaattaaaaccacaatgagataccacttcacacccactagaatggctaaaattaaaaagaccgacaayaacaagtaytggcgaggatgtggagcaactrraactcycatacattgctggtgggaatgtaaaatggtacaaccactttggaaaayagtttggcagtttctacaaaagctaaacacgcgcctaccctatgacccagcaattccactcctaggtatttacccaagagaaatgaaaacatatgtccacacaaagacatgtacaagaatgttcatagcagcattgttcataatagccaaaaagtggaaacaacccagatgtccatcaacaggagaatgaataaacaaattgtggtatatccatacaatggaatactactcagcaataaaaatgaatgaactaytgatacacgcaacaacatgaacgaatctcgaaaacattatgttgagcgaaagaagccagacacaaaagantacatactgnntgattctatttgcataaaatacaaaaccaggcaaaactaatcaatgntgttagaagtcaggatagtggttgttctgggaatagtaatgactgtaaggrarcatgagagggctttctggggtgctggtaatgttctgtttcttgatctgggtgctggttacacggctgtgttcartttgtgaaaattcatyaagctgtacacttatgatwtatgcayttttatgtatgtatattatayytcaataaaaaaaa

SEQ ID NO: 343 - DNA, 596 bp, Homo sapiens
  repeat_region (1)..(596): l1me4
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tttggcaatatctatcaaaatcacacatacatttaccctttgacycagcaatcccacttctaggaatttatcctacagacatacttgcaacatgtacaaaatgacatatatacaaagttantttattgcagcattatttgtaatagcaaaaaaytggaaacaacctaaatgtccatcaataggaaaatggttaaataaattatggtatatccatacaatggaatactatgcagctataaaaaagaatgaagaagatctctatgtactgatatggaatgatctccaggatatattgtttaagtgaaaaaagcaaggtgcaagaatagtgtatatagtatgctaccttttgtgtaaaaaagaaggaaaaataaaaatatatatatatatttgcttatatatgtataaaataactctggaaaaataaacaagaaactnataacagtggttgcctcttntggggggaggggaactgggnngntgggtggctgggggacatgtgggatggacagggatgggagggactgacttttcactgtatacctttttgtactttgtactttttgaaattttgaaccatgtgaatgtattacctattc

SEQ ID NO: 344 - DNA, 1089 bp, Homo sapiens
  repeat_region (1)..(1089): l1mea_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagacttccgattccggtaatggtggagtaagcccctaccggaccaaccctcccgcagaaaacaactataaaacctggacaaaatacaaaaaacaactacttgaaggcactggagagtgaacaaaagcaggcagaaactggaggggagtcgacacttggaagaagggagcwgcacggagtgagttcccatttctgtggcttttagcctgagagcaggccgcagttggtgcggcgtacagatggctaaaacwtcagtagaaaacccgcggtctttctggcctggagaaccagagaantgaatctagggcaaccacagccactggaaagagtggggaaaatcccggaaaggagagagccagagagaggatccccaaattctgtgtataaactctgcccaaatctctggctgacccctgaaccacgcatgcgcggagcagactcaaagcagcccagctaaagacaaaagatctgaactgagactggagctgccgcccaagaaacagagtttgcagttcgagtccagccaagataactgcctactaaaacaaaagaaacaacactcattagagaaaaataacagaatccagaatctccacaatktaacattcatgatgtccaggatacaatcccaaaattatacmacataagaagaaacagraaaaatggaatncatccttaagagaaaagaaaatcaaatccgaccctgagatraaccagatgttggaattaacagacaaggattttaaagcarctattataactatnttcaatgaaataaaacaaaatatgctcacaatgaataaaaggataggaaatctcagcagagaaatagaaacgataaaaagaaccaaatggaaattctagaamtgaaaaatataatatctgaaacaaaaaattcactgaatagacttaacagcagaatggagatgacagaggaaagagtaagtgaacttaaagatagatcaatagaagttatacaatgtgaagagcagagagaaaaawnatttawaaaaaaagwgmakagtctcacaaacatgttcgacaatatcaaatggtcnaacatanatgtaattggaatcmcagaaggag

SEQ ID NO: 345 - DNA, 2523 bp, Homo sapiens
  repeat_region (1)..(2523): l1mec_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aatgtnttaaaaaattcactkaaaacataatasaagacttctgcttccggcyaagatggagtaacagggaccggatttaccctcctrcctgaaacaacyaaaacgcggacaaaatatatgaaacaacggttttcaagacattgracatcaggcagcgmaggacagcgatccctgrgagaagggaaacgaatgaggtgagccctrtgatcgccycagcttactgcctkgagatagtttccaggccacggcacagagaggagaaacccaggcagagcccggcggwctccctgagttgaggagacggagctgagagtycgrggaggccaaggctggctagagttcgcagggcagaataccagagaggagaaagccgcamagagagaacttctgagatctgcagagggtccccytcgagtcttcagctgagtactgaycagcncatgcatgcgaggaaacyacccgaggctagggaaagaaccmcacgaaaggattararggaacaatccccagagctcacacagggccgggaatagttcctgtttccaccagccagagtggaaaacctcataattcacggggcatcgggtagagtactcagaagggttttgcctcagtagcggggaaaaattagccctaaactaaacactgctctggtcccacctaacaaatcttaaaagcaagcctcgaaaagatcaaactgtttccaagtaacttaactgcatcccagaataaagctcaagaatatttawaggaatacaaaaatatccagcacccaamaaggtaaaattcacaatatctggcatccaatcaaaaattaccaggcatccaaagaagcaggaaaatacgacctataatgaggagaaaaatcaatcaatagaaacagacccagaaatgacanagatgatagaattagtagacaaggacatttaaamagttattataactctnnymwatatgttcaagragntaaagaaaaacatgaacataatgaagaaagagrtggaagatataaaaagacccaaatagaacttctagagatgaaaawtayaatrtctgaaatgaaaaatacactggatgagattaacagcagattagacactncagaagaaaraattagtgaacttgaagacatancaatagaaantatccaaaatgaaatacagagacaaagaaannaaaaayagacaaataaaataaagcgtcagtgagctgtgggacaacttcaagtggcctaayacacgtrtwattggagtcaaaaagaaagganagagagaatgaggyagaagaaatattggaagaaacgatagctgagaattttccaaaattgatgaaagacatnaatctacakattcaagaattccaatgaatsccaagyaggataratacagaagaaacaacacatctwgacatatcatagtcaaatcgyagaaaaccaaagayaaagagaaaatcttaaaagcagtcagagaraaacaacatattacgtacagggggacaacaatacaaattaaagctgactttttaccaggcacagtggaggccagaagacagtgggatgawatatttaaagtgctgaaagaaaagaactgtcgacccggaattctatatccagcgaaaatatctttcaaaaataaaggcaaaataaagacattctcagacaaacaaaagctgagataattcattaccagcagacctgcgctacaagaaatgttaaaggaagtcnttcaagcagaaagaaaatgacaccagatggaaacatagatctacacaaagaaatgaagagcgccggaaatggtaamtatacgggtaaatataaaaganatcctttcttattatttnnaatttctttaaaagataattggctgtttanagmaaaaataataacaatgtattgtggggtttataacatatgtaarcaaaatgtatggcaacaatagcacaaaggccggnaggggagaaatggaagtataytgttgtaaggttcttatactntacgtgaagtggtataatrtcatttgaaggtagactgtgataagttaaagatgcatattgtaaaccctagagcaaccactaagataacaaaacaaagagttatagctaataagccaacaaaggagataaaacggaatcataaaaaatacccaattaatccaaaaaaaggcanwaaaaaaaaaatggaacaaagaamagatgggacaaatagaaaacaaatagcaaratgatagatttaaacccaaccatatcaataattacattaaatataaatggtctaaacgctccaattaaaagacagagattgtcagaatggataaaaaaacgagacccaaatatatgctgcctacaagaaacccactttaaatataaagacacaaataggttaaaagtgaaaggatgaaaaatgatatntcatgttaacgccatccaaaagaaagctggagtagctatattaatatcagacgaagtggatttcagaggaaagaataccgccaagagncaaaaaaggtcattttataatgataaagg

SEQ ID NO: 346 - DNA, 990 bp, Homo sapiens
  repeat_region (1)..(990): l1p2_5
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ataaaaaaattaatgagaagaggattctgggaagatggcagagtaggaagcaccaggaatctgtctccccacctagacaacaattgcactggcagaatctgtctgatgtaactattttggaactctggagtctattgaaggcttgcaacttccaggggaaggcttggatggtaaattgtggttaatttcggtcaatttcagctcttagcacagtagcagctacccatcccccacccccagccccgtggcaggcagctgtgcacgtgttcctggagcagcttgcacacagcttgcgggagccagggtgggcaaaaaggatcctgtcctccaaatatcggggatctgtgctctgatcgctgattgctgcttctgatcacagaggtgcagacaaagaggtggcggccattgttgtcgcacctcccyccattgttgcaagcccctccccctctggctgaagtgacttccaggggatttaaagggctagtaccctttctccgctttatttttcttttttccccttttgggagccagacattaaagactaggacattcaaaagcaactgcatatacggggaaaattagaaagtcaccgtgcatgcccagggaaaggcacaggctcagaaaagacctgagaagaccttaagtttacacctcaggctgatccttggcacagagacagcctacaacaataaaaacaaaacaaaaaaataacaaaaacacagcaaaccctggggaagagggagaatctgatttccagagttaccacattattagattcaaatgtccagttttcaacaacaacaacaaaaaatcacaaggcatacaaagaaacaggaaagtatggcccattcaaaggaaaaaaaataaatcaacagaaactgtccctgaaaaagacctgatggcagatctactagacaaagactttaaaacaactgtcttaaagatgctcaaagaactaaaggaaaacgtggagaaagtcaagaaaatgat

SEQ ID NO: 347 - DNA, 1727 bp, Homo sapiens
  repeat_region (1)..(1727): l1p5a1
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ggtggctggcaagatggccgaataggaacagctctggtctgcagctcccagcgagatcaacgcagaaggcaggtgatttctbcatttccaactgaggtacccggctcatctcattgggactggttagacagtgggtgcagcccacggagggcgagcagaagcagggtggggcgtcgcctcacccgggaagcgcaaggggtcagggaactccctcccctagccaagggaagccgtgagggactgtgccacgaggaacgrtgcattccggcccagatactatgcttttcccatggtcttcgcaacccacagaccaggagattccctcgggtgcctacaccaccagggccctgggtttcaagcacaaaactgggcagccgtttgggcagacaccgagctagctgcaggagtttttttttttcgtaccccagtggcgcctggaacgccagtgagacagaactgttcactcccctggaaagggggctgaagccagggagccaagtggtctagctcagtggatcccacccccacggagcccagcaagctaagatccactggcttgaaattctcgctgccagcacagcagtctgaagtcgacctgggatgctcgagcttggtggggggaggggcatccgccattactgaggcttgagtaggcggttttcccctcacagtgtaaacaaagccaccaggaagttcgaactgggcggagcccaccacagctccgcaaancggctgtagccagactgcctctctagattcctcctctctgggcagggcatctctgaaagaaaggcagcagccccagtcaggggcttatagataaaactcccatctccctgggacagagcacctgggggaaggggcggctgtgggcgcagcttcagcagacttaaacgttcctgcctgccagctctgaagagagcagcggatctcccagcacagtgctcgagctctgctaagggacagactgcctcctcaagtgggtccctgacccctgtgcctcctgactgggagacacctcccagcaggrgtcgacagacacctcatacaggagagctccggctggcatctggtgggtgcccctctgggacgaagcttccagaggaaggaacaggcagcaatctttgctgttctgcagcctccgctggtgatayccaggcaaacagggtctggagtggacctccagcaaactccagcagacctgcagcagaggggcctgactgttagaaggaaaactaacaaacggaaagcaatagcatcaacatcaacaaaaaggacgtccacacagaaaccccatccgaaggtcaccaacatcaaagaccaaaggtagataaatccacgaagatgaggaaaaaccagtgcaaaaaggctgaaaattccaaaaaccagaacgcctcttctcctccaaagaatcacaactcctcgccagcaagggaacaaaactggacggagaatgagtttgacgaattgacagaagtaggcttcagaaggtgggtaataacaaactcctccgagctaaaggagcatgttctaacccaatgcaaggaagctaagaaccttgaaaaaaggttagaggaattgctaactagaataaccagtttagagaagaacataaatgacctgatggagctgaaaaacacagcatgagaacttcgtgaagcatacacaagtatcaatagccgaatcgatcaagcagaagaaaggatatcagagattgaagatcaact

SEQ ID NO: 348 - DNA, 7678 bp, Homo sapiens
  repeat_region (1)..(7678): l1p_ma2
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gaaggcggaacaagatggccgaatagaagmctccaccgatcatcctccctgcaggaacaccaaattgaacaactatccacacaaaaarstaccttcataagaaccaaaaatcaggtgagcgatcacagtacctggttttaacttcatatcactgaaagaggcactgaagagggtaggaaagacagtcttgaattgccgatgccaccactccyccatkcccgggcagtggcwgwgtggtgtggagagagaatctgtgcgcttgggggagggagagtgcagkgattgtgagactttgcattggaactcagtgctgccctgtcacagtagaaagcaaaaccaggcagaactcagctggtgcccacggagggaacatttagaccagccctagccagaggggaatcgcctatcccagtggtcggaacctgagttccggcaagccttgccaccgcgggctaaagtgctctggggytctaaataaacttgaaaggcagtctaggccamaaggactgcaantcctrggcaagtcctagtgctgwactgggctcagagycagtggacttgggggacacatgacctaaggagacaccagctggggcagcyaagggagtgcttgcaccacccctcyctyaactccaggcagcacagctcacggctccgaaagagactccttccttctgcttgaggagaggagagggragagtaaagaggactttgtcttgcaacttggataccagctcagccacagtaggatagggcaccarkcagagtcmtgaggcccccwttccaggccctggctcccggacaacatttctagacacaccctgggccagaagagaacccgctgccttgaagggaaggacccagtcctggcaggatkcatcacctgctgactaaagagcgcttgggccctgaatgatcarcagcgrtacccaggcartactcastgtgggccttgggtgagactcagagacttgctggcttcaggtgtgactcagcacattcccagctgtggtggctatggggagagactccttytgcttgagaaaagsagagggaaaagtaaaggggactttgtcttgcaccttaggtaccagctcggccacagtgggrtagagcaccaagtaggctcttggggtccccgattccaggacttggctcttggatggcatttctggacctgccctgggccagaggagagcccactgtcctgaagagagagtcccaggcctggcagcattcaccacaagctgactgaagagcccttgggccttgagwgaacattggcggtagccaggcagtactctccatgggcctgggrtggtggtggccacagggagcgactcctttgcctgtggaaaggggagggaagagtgggaaggactttgtctcgtggtttgggtgccagctcagccacggtagaatagagcaccaggtagatttctaaggtttctgactccaggccctggctcccggatgacatctctggacctgcctgrggccwgggggaacttaccaccctgaagggaaggacacaagcctggctkgcttttscayctgctgattgtagagccctagggccttgagcgaacataggcggtagccaggyagtggttacagcaggccttgggtgagacccagtgctrtgctggcttcaggtctgacccagcacagtcccagtggtggtggccacaggggtgcttgtgtcaccmctcccagcttcaggcagctcagmacagagagagagactccatttgtttgggggraagtaagggaagagaacaagagtctctgcctggtaatccagagaattcttccggatcttatccaagaccaccaaggcagtacctctatgagtctgcaagaaccacagtgttaytgggcttggggtgccccctaawgcagatatggctacatgaccaaaarcttagatcayaacacccaagtccsttcaaatacctggaaagccttcccaagaagratgggtacaaacaagcccagactgtgaagactacaataaatacctaactcttcaatgcccagacactgacgaacatccacaagcatcaagaccttccaggaaaacatgacctcaccaaacgaactaaataaggcaccagtgaccaatcctggagaaacagagagatatgtgayctttcagacagagaattcaaaatagctgttttgaggaaactcaaagaaattcaagataacacagagaaggaattcagaattctatcagataaatctaacaaagagaytgaaataattawaaagaatcaagcagaaattctggagctgaaaaatgcaattggcatactgaagaatgcatcagagtctyttaacagcagaattgatcaaacagaaraaagaattagtgagcttgaagacaggctatttgaaaatacacagtcagaggagacaaaagaaaaaagaataaaaaacaatgaagcatgcctacaagatctagaaaatagcctcaaaagggcaaatctaagagttattggccttaaagaggaggtagaaagagagataggggtagaaagyttakttcaarggataataacagagaacttcccaaacctasagaaagatatcaatattcaagtacaagaaggttatagaacaccaagcagatttaacccaaagaagactacctcaaggcatttaataatcaaactcccaaaggtcaaggataaagaaaggatcctaaaagcagcaagagaaaagaaataacatgcaatasagctccaatacgtntggcagcagacttttcagtggaaaccttacaggccaggagagagtggcatgacatatttaaagtgctgaaggaaaaaacttttaccctagaatagtatatccagtgaaaatatccttcaaacatgaaagagaaataaagactttcccagacaaacaaaagctgagggatttcatcaacaccagacctgtcctgcaagaaatgctaaagggagttcttcaatctgaaagaaaaggacgttaatgagcaataagaaatcatctgaaggtacaaaactcactggtaatagtaagtacacagaaaaacacagaatatcgtaacactgtaattgtggtatgtaaactactcatatcttaartagaaagactaaaaaatgaaycaatcaaaaataataactacaacaattttcaagacatagacagtacartaagatataaatagaaacaacaaaaagttaaaaagagaggggatgaagttaaagtgtagagtttttattagttttcgattgtttgcttgtttgtttatgcaawcggtgttgttatcagcttaaaataatgggttataagataktatttgcaagcctcatggtaacctcaaatcaaaaaacatacaacagatacacaaaaaataaaaagcaagaaattaaatcataccaccagagaaaatcaccttcactaaaagaaagacaggaaggaaggaaagaaggaagagaagaccacaaaacaaccagaaaacaaataacaaaatggcaggagtaaatccttacttatcaataataacattggaatgtaaatggactaaactctaatcaaaagacatagagtggctgaatggataaaaaaaacaakacccaatgatctgytgcctacaagaaacacacttcacctataaagacacacatagactgaaaataaagggatggaaaaagatrttccatgcaaatagaaaccaaaaaagagcaggagtagctatacttatatcagacaaaatagayttyaagacaaaaactataagaagagacaaagaatgtcatttaatgataaaggggtcaattcagcaagaggatataacaattttatatatatgcacccaacactggagcacccagatatataaagcaaatattattagagctaagagagagatagaccccaatacaataatagctggagacttcwmcacctgtcttttagcattagaaawatcwtccagacagaaaatcaacaaagaaacattgkacttaatctgcactatagaccaaatgracctaatagayatttacagaacatttyatccaacagctgcagaatacacattcttctcctcagcacatgratcattctcaaggatagrccatatntnaggtcacaaaacaartcttaaaacattcaaaaaattgaaattatatcaagyatcttctctgaccacaatggaataaaactagaaatcaataacaagagraattttggaaactatacaaacacacggaaattaaacaayatgctyctgaatgaccagtgkgtcaatgaagaaattaagaaggaaattkaaaaatttcttgaaacaaatgataatggaaacacaatataycaaaacctatgagatacggtaaaagcagtactaagagggaaagtttatagctgtaagtgcctacatcaaaaaagaagaaaaacttcgaataaacaacctaatgatgcatcttaaagaactagaaaagcaagagcaaaccaaacccaaaattagtagaagaaaataaataataaagatcagagcagaaataaatgaaattgaaataaagaraacaatacaaaagatmaatgaaacaaaaagttggttttttgaaaagataaacaaaattgacaaacctttagccagaytaagaaaaaaagagaagacccaaataaataaaatcagagatgaaaaaggagacattacaactgataccacagaaattcaaatgatcattagaggctactrtgagcaactatataccaataaatcggaaaacctagaagaaatggataaattcctagacacatacaacctacyaagattgaaccatgaagaaatccaaaacctgaacagaccaataacaagtaacgagatcgaagccgtaataaaaagtctcccagcaaagaaaagcccgggacctgatggcttcactgctgaattttaccaaacatttaaagaattaataccaatcctactcaaactattctgaaaaaagaggaggaaggaatacttycaaactcattctatgaggccagtatyaccctgataccaaaaccagacaaagacacatcaraaaaawaaaactacaggccaatattcctgatgaatattgatgcaaaaatcctyaacaaaatactagcaaaccaaattcaacaacacattaaaaaratcattcatcatgaccaagtgggatttatcccagggatgcaaggatggttcaacatatgcaaatcaatcacaatcgatrtgatacatcatatcaacagaatgaaggacaaaaaccatatgatyatttcaattgatgctgaaaaagcatttgataaaattcaacatcccttcatgataaaaaccctcaaaaactgggtatagaagaacatayctcacgacacaataaaagccatatacgacagacycacagctagtatcayactgaatggggaaaaactgaaagcctttccyttawgatctgraacatgacaaggatgcccactttcaccactgttattcaacatagtactggaagtcctagttagagcaatcagacaagagaaagaaataaagggcatccaaattggaaaggaagaagtcaaattatccttgtttgcagatgatatgatcttatatttggaaaaacctaaagactccaccaaaaaactattagaactgataaacaaattcagtaaagttgcaggatacaaaattaacatacaaaaatcagtagcatttctatatgccaacagtgaacaatctgaaaaagaaatcaagaaagtaatcccatttacaatagctacaaataaaattaaatacctaggaattaatktaayaaaawaaktgaaagatstctayaatgaaaactataaaacactgatgyaagaaattgaagaggacacaaaaaaatggaaagatattccatgtttatggattggaagaatcaatattgttaaaatgyccatactacccaaagcaatctacagattcaatgcmatccctatcaaaatacyaatgacatttttcacagaaatagaaaaaacaatcctaaaatttatatggaaccacaaaagacccagaatagccaaagctatcctaagcaaaaagaacaaaactggaggaatyacattacctgacttcaaattatactacagagmtatagtaaccaaaacggcatggtactggcataaaaacagacacatagaccaatggaacagaatagagaacccagaaacaaatccatacatytacagcgaactcattttcgacaaaggtgccaagaacatacactgaggaaaagacartctcttcaataaatggtgctgggaaaactggatatccatatgcagaagaatgaaactagaccccatctctcgccatatacaaaaatcaaatcaaaatrgattaaagacttaaatmtaagacctcaaactatgaaactactaaaagaaaacattggggaaactctccaggacattggatttgggcaaagatttcttgagtaataccccacaagcacaggcaaccaaagcaaaaatggacaaatgggatcayatcaagttaaaaagcttctgcacagcaaaggaaacaatcaacaaagtgaagagacaatycacagaatgggagaaaatatttgcaaactacccatctgacaagggattaataaccagaatatataaggagctcaaacaactctataggaaaaaaatctaataatctgatttaaaaatgggcaaaagatctgaatagacatttctcaaaagaagacatacaaatggcaaacaggtatatgaaaaggtgctcaacataaytgatcatcagagaaatgcaaatcaaaactacaatgagatatyatctcactccagttaaaatggcttttatccaaaagacaggcaataacaaatgctggygaggatgtggagaaaagggaaccctcgtacattgttggtgggaatgtaaattagtacaaccactatggagaacagtttggaggttcctcaaaaaactaaaaatagagctaccatataatccagcaatcccactgctaggtatataccccaaagaaaggaaatcagtatattgaagagatatctgcactcccatgtttattgcagcaytgttcacaatagccaagatttggaagcaacctaagtgtccatcaacagatgaatggataaagaaaatrtggtacatatacacaatggagtactattcagccataaaaaagaatgagatcctgtcatttgcaacaacatggatggaactggaggtcattatgttaagtgaaataagccaggcacagaaagacaaacatcgcatgttctcacttatttgtgagakctaaaaattaaaacaattgaactcatggaaayagagagtagaaggatggttaccagaggctgggaagggtagtgggaggkngkgggaagtggggatggttaatgggtacaaaaatatagttagatagaatgaataagayctagtatttgvtagcacaacagggtgactacagtcaaaaataatttattgtayatttwraaataactaaaagagtataattggattgtttgtaacacaaaggataaatgcttgagatgatggataccccatttaccctgacgtgattattatgcattgtatgcctgtatcaaaatatctcatgtaccccataaatatatacayctattatgtacccayaaaaat

SEQ ID NO: 349 - DNA, 912 bp, Homo sapiens
  repeat_region (1)..(912): l1pa11
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ctaatatccagaatstacaargaacttaaacaaatttacaagaaaaaaacaaamaaccccatcaaaaagtgggcaaaggacatgaacagacacttctcaaaagaagacatwtatgtggccaataagcacatgaaaaaaagctcaacatcactgatcattagagaaatgcaaatcaaaaccacaatgagataccatctcayrccagtcagaatggcaattattaaaaagtcaagaaacaacagatgctggygaggctgtggagaaataggaatgcttttacactgttggtgggaatgtaaattagttcaaccattgtggaagacagtgtggcgattcctcaaggatctagaaccagaaataccatttgacccagcaatcccattactgrgtatatacccaaaggaatataaatcattctattataaagacacatgcaygtgtatgttyattgcagcactattcacaatagcaaagacatggaatcaaccyaaatgcccatcaatgatagactggataaagaaaatgtggtacatatacaccatggaatactatgcagccataaaaaagaatgagatcatgtcctttgcaggaacatggatggagctggaggccattatccttagcaaactaaygcaggaacagaaaaccaaataccgcatgttctcacttataagtgggagctaaacgatgagaacacatggacacatggaggggaacaacacacactggggcctgtcggagggtggagggtgggaggagggagagcatcaggaaaaatagctaatggatactgggcttaatacctgggtgatgggatgatctgtgcagcaaaccaccatggcacacgtttacctatgtaacaaacctgcacatcctgcacatgtaccccggaacttaaaataaaagttgaaa

SEQ ID NO: 350 - DNA, 3075 bp, Homo sapiens
  repeat_region (1)..(3075): l1pa12_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ggaggtggccaagatggccgactagaagcagctagtgtgtgccgctctcatggagagaaatggaaggggngagtaaatacagcaccttcaactgaaacatccaggtacacgcattgggactaatcaagaaaacaacttgacccatggagaacggagaaaagcaaggcaggacgacggcccacccgggagcgacacggagccaggggagcctcccccgcccagggaagtggtgagtgaatgtgcggccccgggaacccacgcttctcccacggatctttgcaaccctcaggtcaggagatcccctcgtgaacccactccaccagggccttcagtctgacacacagagctatgtggagtctcggcagagcagccgctcaggcatgcgtggagaccctggagccttagatacccgggcttcccggcaaaagtagctgcaactccagcaaagcgggaggttagacccccatacatacccctaggaaagaggctgaatccagggggccgagcagtgayagtctgcaggccccacttccacrgcacctcacaggataagacccactgacttggaatttcagcyagccacyggtagcagcgttgcacctmcctgraacrgagctcccagggggaaggggcgggctgccatctttgctgtttgggcgacttagccattccagccttcgggctttggagagtccaagccaactaggggcagaagsgatcccccagcacagmmcagcwgctctaccaaaacrtggccagactgcttctttaagtgggtccccgatcctattcctcctcgctgggcgggacctcccaaccggggcctccagccacccccgctggtgttytctagccgacagagatttgtaattctccctgggacggagttcccagagggaagggcgggccaccatctttgctgtttgrgcggctcagccgttccaaccttcgggctttggagagcccaagctgaccgggggcngaaggaatcccccagcacagcacagctgctctaccaaaamgcggccagactgcttctttaakcgagtccccgatcccatttctcctcactgggcgggacctcccaaaccgggtctccagccacctcctgcakgtgttctcnggctaacagagatttgaaccyccctgggacgragctyycagagggaggggcaggcygccatctttgctgtttsrkarmcttmrctgttsawaccttcaggcwytggaraattyaaggcgacyagggkctrgancggacccccagcacagyacagcwgcyctaysraaawgtggccagactttttkttaagtaggtcccnaatcccntwtctcctcactgggtgggacctnccaaccagggtctccagccacctcctncaggtgnttttgggctggcaacaggtccgtacctccctgggacgaagctcccagaggcaggggcaggctnccatcttcgctgtttcgtagccttcactggtgatacctccaggtactagaaaatncgaggtgactanngactggagcgggcccccagcatattrcagcagccctacggaaaagtggccagactgttatgtgggtscctawtcccatatctcctcactgggcgggtcctccaggcctgggtctccagccaccacyyaccggggctgtcgngccagtaccarctcwgcaactccctggacagagccyccaggggaaactgaaagcctctctgccactgcctctgcagtggaactgcccttgctaccctcagactaacgaaggagsaaagaccctaagtgccttatccacacctccaacaagctgcagtcgacccaaggagaggaggccagtctgtctcycacnggtcccacmcaccccccacwgcttgtcaccasrcaggraacccctggcttgggcccacagcacagaccctccatcctgggctgactgcactgagcgattgctgacctgcatctctctggggtggagcccccaggagacaagcaaaagaccctcggccacaaccactactaaggtcccttcctccgckgcctccaagttggggagaaaacataaaccctgagatcaccccagagctgttatgngcagcccggnagtgccaagntacgatctacagccagcactcaagtgngagaggagnccacactttcatagcattgagagggaacanggctgcaaangtgaggaaatacaggggagccacacgactgagcaagagcctaccaactgaccactnnanctaagngtcacctactggatcacgccctaaagcttcaagaccaaaagtacttcacaaacatagccccctgtgaaacaagagacaggaagtaagcttcaaataaagaccatgcacaaagcctcagcccagtgaaaacatccaaaaaggaagtctattgattgtattcaatgcacactgcagttaaaggaanatccacanacagagatgagaaagaaccaacgcaagaactcgcgtaactcaaatggtcagagtgtcttatgtcctccaaacgantgcatagttttccaacaaaggttcttaactaggctgagttggcatgaatgacagaaatagaattcagaatatggataggaacaaagatcattgagattgaggagaatggcataacccaattcagggaaactaagaatcacaaaatcatgataaaacgatacaggagctgaaggacaaaatagctggtataagaatgaacctaacaaatacatctgatagagatgaaaaacacactacaagaatttcacaatgcaatcacaagtattaatagcagaataaagcaagctgaggaaagaatctcagaaattgacaactggctctctgaaataagacagtcagacaatcacaaagaaacaagaataaaaaggaatgaacaaaacatgcaagaaatatgggattatgtaaagaggccaaatgtatgaacgactggcatcactgaaaggatggaggagaaagcaaacaacttggaaaacgtatttcaggatatcgttcatgaaaacttccgcaaccttgctagaaaggccataagtcaaactcagaaaatatggaaaact

SEQ ID NO: 351 - DNA, 904 bp, Homo sapiens
  repeat_region (1)..(904): L1PA15
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ctaatatccagaatstacaargaacttaaacaaatttacaagaaaaaaacaaamaaccccatcaaaaagtgggcaaaggacatgaacagacacttctcaaaagaagacatwtatgtggccaataagcacatgaaaaaaagctcaacatcactgatcattagagaaatgcaaatcaaaaccacaatgagataccatctcayrccagtcagaatggcaattattaaaaagtcaagaaacaacagatgctggygaggctgtggagaaataggaatgcttttacactgttggtgggaatgtaaattagttcaaccattgtggaagacagtgtggcgattcctcaaggatctagaaccagaaataccatttgacccagcaatcccattactgrgtatatacccaaaggaatataaatcattctattataaagacacatgcaygtgtatgttyattgcagcactattcacaatagcaaagacatggaatcaaccyaaatgcccatcaatgatagactggataaagaaaatgtggtacatatacaccatggaatactatgcagccataaaaaagaatgagatcatgtcctttgcaggaacatggatggagctggaggccattatccttagcaaactaaygcaggaacagaaaaccaaataccgcatgttctcacttataagtgggagctaaayattgagtacacatggacataaagaagggaacaacagacactggggcctacttgagggtggagggtgggaagagggagaggatcaaaaaactacctatcgggtactatgcttattacctgggtgatgaaataatctgtacaccaaaccccagcgacacgcaatttacctatataacaaacctgcacatgtaccccctgaatctaaaataaaagttaaaa

SEQ ID NO: 352 - DNA, 1992 bp, Homo sapiens
  repeat_region (1)..(1992): l1pa15_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
aagatggctgactagatgcagccaggwggaacakctcccactgagggaccaggacatcaggaagactggcacactcctarcagatcttcagagggaaggcaytgagagtggacggagggaagacacagawgctgggctgaagggggaggaagctgggaaccctgcacggggctaccrmgcaccaggactcgttcctggcccccagtgactcctggggaakgggtgagttgaacaggcaaggagyracccactctcaccatggacctctggaatcctagcagsaggagaccccwcgaccmccayrgacacttgagytggcagggagagctgcttagagaagtggtaggggcagramtccagcctgtgtggagcccagagggtttggtgcaggarcatctgtagtggagcacggccagggaygcccatcccccaaggctcamcatgctcccataggagactttagcccttagggkaactgtyrgacctgaacwctgcagggtrgtcttgcccatgagacrgggccagtctgacctgagcaccccttggtctgctggcctctccyggggccccagcctggccacacctgcttgcagtgcagcctccaggtgcctcctgggggcccacatcatagcttctgcactggcagaccatgcctgaccagcagagagctccagcagggcggcccccatggmcacgcaccagcctgcatgctccctccccacactgcagcttccccatggygctttgcctgcacacattnrcccatggcaactccccacatcactttgctggcacgtgtctgcatrggtggrttttgctttccttgccctgccagygtacatgtgygagtgcaccctgctgtgccactgctgctggygggagtgcaccccccacccattctcccatacctsctgactgccattgcagatggagccttggtgggcacagagccagccagccccacccccaccagyrcccyrcccytgyrctaacactgcccctggagtgaaaccaggcacaagaacagcggatyctccccyaccctgagcgaccactcctgcttgtggggcacagagaaggcacacagacctcacmcagwyctgwgccgaccagcgcttcgccccgtgctaacaccaccwccggtgcaancgcawgcacagwcgccggcgrcggcccctcgccgctctgagccgttctgccwctgctgccgctgtgaatgcscacagggaggcaggcacccccgcacccgctagtacccccnacccccacctaaggcgttgagcgygcaccctgccgtgccgccgctgctgctggcacacgcaagcaagcatagatcctgctgccaccgccccaaaaaagcactttggctggcaccacccatcggagtgttgtggccagtggaccgggaacacctcggncccyccagcgcagcaggttcctaacctcgaggggccagagaacaaagctggggacccgrtaccagccccccagagttagagcacacagcccaggagtgctgagctgagccttggncccctaaaatcttccagaaacgaanccagtcaactgaacccaccttataccacaatcaaacccccaagggcatcaaagaagatraaagaaaaaaaaaycatccaaaggacagcaacttcaaagattgaaggaacatcagcccacamagatgagaaagaaccagtgcaagaactctgrcaactcaaaaagccagartgycttctttcctscaaatgactgcaytasttcyycagcaakggttcktaactaggctgaaatggctgaaatgncagaaatggaattcagaatatggataggaatgaagatcatcaagattcaggagaamgtcgaaacccaatccaaggaakctaaggaatcacaataaaacgatayaggagctgamagacaaaatggccaktwtaraaaagaaccwaactgatytgatagagctgaaaaacwcgctacgagaatttcataata

SEQ ID NO: 353 - DNA, 1884 bp, Homo sapiens
  repeat_region (1)..(1884): l1pa15_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tttttttcccaagatggcggattagaggcttttagtatgcctcagccacttggaaatggnaaaatagtgcataaagatcaactctgtgagctttaattcaagaaggaaaatgggaatccaccataatcgtgaaggacaccccagatcctagggaggagaatgtnggcaaacagcccctatgatggcgtccagctgataaaagtgagtgaagccccagtacgcgagagaggcagagagtctccctctgtgactcacttttccactggggatccgagcaacccaggccaagggagaacactttgtttctcccaagccctggagctaacgtggggagaggcttggagatgctgtgagggaaagacaccgggaaaagctgcagacattttcccagacctaggamcaagagcaggatgccatttttaatccgggcgcatacaaagtcagccattctttggcgacccggcagcgtggccgcgcaggcattttagtctcaggccagagattggagcgcctgctctggagtagggtaggggcctccacagccagaactgtgaaaagcgcctcagcagtaggcgctggaattgtgctctcccctactgcaagcctggggcgggaggagagctgctacagctgcagtttctcctgggcggcgagacttgcagccagggccagcttggcgacctggaactggtctgtgtgtgccattgctgggtgccccagcctgctcccctgagatcgtggtgcagsggggccctctctgctccacgcccaggcagatctccaggcattcagagcacccgctcgcctggwtcagcagcctgagccgccccacccttcctgkgcatagatcgtggtgcagsggggccctctctgctccacgcccaggcagatctccaggcattcagagcacccgctcgcctggwtcagcagcctgagccgccccacccttcctgkgcatagatcgtggtgcagsggggccctctctgctccacgcccaggcagatctccaggcattcagagcacccgctcgcctggwtcagcagcctgagccgccccacccttcctgkgcatagatcgtggtgcagsggggccctctctgctccacgcccaggcagatctccaggcatctggagcacccactctcctggattaggagtttaagccgccccacccttcccgtgcagagaacttggggctgaggaggtttccctgctccacgcctaggcacacctctgggcgcttggtggctgcccactggattctcccttggcgctggcgcttgtgcccgccatcgggagatctgtaggcggacctgcctagtccggccccacccatcttggmccccgcccctccagggctgagcagrsagttcagancactntgcattccatgcatcagcccattkcctgaggcaacagagagcttctnccagtaaacaaggatcaaatatatacccagccacactggccgtagctagctcttacctataagcgccatctactggcttgtaggtcaaactgcacwgcccaatataaaacctgctaaaagaagtgcatagggctatagaagcaaagccaaaagaccatacccagcattctctacagtcacaccmcctagggaggaggagaaaggaaagggaaagaaaaaacaccaataatattatagggaaagaaagaaaagaaaaaaccctactcncatggaaataattacaaaaattagaagtgccagnatctccagatgagaaggaaccagcacaagaattntggcaccatgaaaaatctgaatgtagtgacaccaccaaaggatcgcactagctctccagcaatggttcctaatcaaaacggaaactcagaaatgacaggcaaagaattcaaagcatggatt

SEQ ID NO: 354 - DNA, 893 bp, Homo sapiens
  repeat_region (1)..(893): l1pa2
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaa

SEQ ID NO: 355 - DNA, 892 bp, Homo sapiens
  repeat_region (1)..(892): l1pa7
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ctaatatccagaatctacaaggaacttaaacaaatttacaagaaaaaaacaaacaaccccatcaaaaagtgggcaaaggatatgaacagacacttctcaaaagaagacatttatgyagccaacaaacayatgaaaaaaagctcatcatcactggtcattagagaaatgcaaatcaaaaccacaatgagataccatctcaygccagttagaatggcgatcattaaaaagtcaggaaacaacagatgctggagaggatgtggagaaataggaatgcttttacactgttggtgggagtgtaaattagttcaaccattgtggaagacagtgtggcgattcctcaaggatctagaaccagaaataccatttgacccagcaatcccattactgggtatatacccaaaggattataaatcattctrctataaagacacatgcacacgtatgtttattgcagcactattcacaatagcaaagacttggaaccaacccaaatgcccatcaatgatagactggataaagaaaatgtggcacatatacaccatggaatactatgcagccataaaaaaggatgagttcatgtcctttgcagggacatggatgaagctggaaaccatcattctcagcaaactaacacaggaacagaaaaccaaacaccgcatgttctcactcataagtgggagttgaacaatgagaacacatggacacagggaggggaacatcacacaccggggcctgtcggggggtggggggctaggggagggatagcattaggagaaatacctaatgtagatgacgggttgatgggtgcagcaaaccaccatggcacatgtatacctatgtaacaaacctgcacgttctgcacatgtatcccagaacttaaagtataataata

SEQ ID NO: 356 - DNA, 606 bp, Homo sapiens
  repeat_region (1)..(606): l1paxx_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ggggtggggccaagatggctgactagaagcagcwgcgatcggaggctcccatggaaaagaaccaaaacagtgtgtaaatcctgcaccagcaactgaggtatccaggttctctcatcaggactgactaggcagctggcatgacccatggagaggaaggaagagcagtgtggtgtggcggcccacctgagagccacacggggcaggggagcccccaccccccagccaagggaggcagtgagtgagcatgctacccagcctgggaaaccgtgctttttccacggaactgtgcaacccatggatcrgaagatcccactcrtgaacccacrccaccagggcctagsgtcccaaccccggagctgtgcagattctcaacagcctctcagctggaatctgcttaagcctaccgagctcccggggggaggggcgaccagcaccacagctgcagctgcctgctgtctaagccatttgagctccttgggggaggggcagcagccagcactgggactcacaactgcctaacacnctaagctccctgggcaggggaagggcagcatccatctctatagctccaggctgtgcttttcccctgctggagccagggaggct

SEQ ID NO: 357 - DNA, 902 bp, Homo sapiens
  repeat_region (1)..(902): l1pb1
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ctaatatccagaatctataaggaactcaaacaaatcagcaagaaaaaaacaaacaatcccatcaaaaagtgggctaaggacatgaayagacamttctcaaaagaagatatryaaatggccaacaagcatatgaaaaaatgctcaacatcactaattatcagggaaatgcaaatcaaaaccacaatgcrataccatcttactcctgcaagaatggccataattaaaaaatcaaaaaataatagatgttggcgtggatgtggtgaaaagggaacacttytacactgctggtgggaatgtaaactagtacaaccactatggaaaacagtatggagattycttaaagaactaaaagtagaactaccatttgatccagcaatcccactactgggtatctacccarargaaaakaagtcattataygaaaaagayacttgcacacrcatgtttatagcagcacaattyrcaattgcaaaaatatggaaccaacccaaatgcccatcaatcaayragtggataaagaaaatgtgrtatatatataccatggaatactackcagccataaaaaagaatgaaataatggcatttgcagcaacctggatggarytggagacyattattctaagtgaagtaactcaggaatggaaaaccaaacatyrtatgttctcacttataagtgggagctaagctatgaggatgcaaaggcgtaagaatgatacaatggactttggggactcgggagatcgggrgaaagggtgggaggggggtgagggataaaagactacaaattgggtacagtgtacactgctcgggtgatgggtgcaccaaaatctcacaaatcaccactaaagaacttattcatgtaaccaaacaccacctgttccccaaaaacctattgaaataaa

SEQ ID NO: 358 - DNA, 897 bp, Homo sapiens
  repeat_region (1)..(897): l1pb3
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ctaatatccagaatctataaggaactcaaacaaatcagcaagaaaaaaacaaacaatcccatcaaaaagtgggctaaggacatgaayagacamttctcaaaagaagatatryaaatggccaacaagcatatgaaaaaatgctcaacatcactaattatcagggaaatgcaaatcaaaaccacaatgcrataccatcttactcctgcaagaatggccataattaaaaaatcaaaaaataatagatgttggcgtggatgtggtgaaaagggaacacttytacactgctggtgggaatgtaaactagtacaaccactatggaaaacagtatggagattycttaaagaactaaaagtagaactaccatttgatccagcaatcccactactgggtatctacccarargaaaakaagtcattataygaaaaagayacttgcacacrcatgtttatagcagcacaattyrcaattgcaaaaatatggaaccaacccaaatgcccatcaatcaayragtggataaagaaaatgtgrtatatatataccatggaatactackcagccataaaaaagaatgaaataatggcatttgcagcaacctggatggarytggagacyattattctaagtgaagtaactcaggaatggaaaaccaaacatyrtatgttctcacttataagtgggagctaagctatgggtatatacgggcatatagagtggtataatagacaytggagactcaaaaggtggagggtaggagaggggtgagggatgaaaaattacctattgggtacaatgtwcactattcgggtgatgggtacactaaaagcccagacttcaccactayacaatatatccatgtaacaaaaakgcacytgtaccccctaaatytataaaaataaa

SEQ ID NO: 359 - DNA, 2247 bp, Homo sapiens
  repeat_region (1)..(2247): l1pba_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
acaaantagggaaaaatggcggataggaggcaggactaaattgcagctcccactcggatggacagagcagcatgtggagactcacatcgtgaacttttgctccaagaaccaccgcaggaatataycaagaaagccgagagaatycacagaccctctgaaggaagcagattgctcctgcargayccaggaaacggcccaaaaactgtgagtgcccaaagtgtgagaagggraaaatctgcccccgaacacacatcctyactggggaacctgaagatccagatcacaggagaaggatttgaccttacctggagctgagacaatttagagggccgagcaaaatacaggggtagaggaagcagtgggaaaagccctgtgggctctccgggtccccagggaagccatttctgactttgtctcacaggggtccctggggagggctgccagwggaactggggaaaggccacagggagaaggaaacctccagctgaactttgtaacaattccgaccgaacgcgaagtttcctggccagaactcaggggagggcgtgaatccggwgtgcagactcagcacagaagccgtggcaggcaggaggcgcgaagcctgaaagccctgcttgctttctcagcwgggaggctggtagcctggggcaagttctcagccctgctcaccaactgcctggaaataaactcggtgctgttgtgggggggcacggtgggagtgagaccggccttttkggttgcatgggagctgggtgaggcctgtnactgccagctttcccccacttccctggcgacctgcatgacacagcagaggcagccataatccccctgggaacgtaactccattggcctgggaactacacccccatccctcacagtagccgcagcaagccccgcccaaggagactctgagctcagacatgcctaaccctgcccccacctgatggtctttctctacccaccctggtagccgaagacaaaagacataawctcttgggagctctayggccccacccatcgcctgagaaacwgaaatayttaycywggcmamcttagggcaagcttrtatccwccctatactrtcgcagctgatgccctcttgaaagcgccacctcttggctggaggccaaccaactcaagacattacagcaaytcayracagaataaccctgcccctarrraaggagaaaacgacagctatcaccactgcctgcaacatcctggctaaccagaggtcctgagtctgtccacgtgayaasttcactrctakyataaccagcattcgagaaarccagcacactaagtctatctacaaccaaggaatctcacagagtctayttcactcccctgccacctccatcagagctggtgctggtattcaccgctgrgagacttgaagacaggtcacatcacwggatycyttgcagacattccccagyaccagcccggagtctggtagctccactgggtggctagayccagaagagcaataacgatcactgyagtccggctctcaggaagtcccattcctaggrgaagggggagagcaccacatcaagggaacaccctgtgggacaaaagaatctgaacggcagsccttgagtcccagatcttycctctgacatagcctacccaaatgagaaggaaccagaaaaayaattctggtaatatgacaaaacaaggttctttaacacccccaaaaratcacactagctcaccagcaatggatccaaaccaagaagaaatcyctgaattgccagaaaaagaattcagaaggtcgattattaagctactcaaggaggcaccgaggaaggtgaanaccaacttaaagaaanttanaatataatacaggatatgaatgraraaatctycagwgaaanagatagcataaakaaaaaacaatcamaacttcwggaaatcgaagyacacttatagaaatgcgaaatgcwctggaaagtctcarcaatagaatngaacaagcagaagaaagaacttcagagctcgaagacaaggytttcaaattaacccaatccgacaaagacaaagaaaaaagaataagaaaatatgaacaaagcctccaagaagtctgggattatgttaaacgaccaaacctaagaataatcggcgttcctgagnaagaagagaaatctaaaagtttggaaaacttattcgnggaaataatcgaggaaaacttccccgrcsttgctaragayctagayatccaamtacaaagaagctcwawraaca

SEQ ID NO: 360 - DNA, 945 bp, Homo sapiens
  repeat_region (1)..(945): l1pbb_5
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
kggtgggaagtttctttcagcagaggcacagktgcagtgctgggctcagtggggaaagtctgcgcctctaccccaacagtcaggcagccctggtgmttgtgaagggtcttggagaagggattccttctccccctcacccaccactgcagacacagctggggcttctcccacaggaackcagcatgggtgcacctatagacagcctttctggaacaattcagggtgantgcatccccacaggaggagcgccctccaggttcaggcttgcacgagaggcagagtcacaattcctctctacttggaacatcaacattcctgcagatgaaaagaggtgcctgtctgatctgaatagctggaacactgggacaggagtgwggctgkgaggtggatmgctttcctgctggcctggcaggggagctgaggtggctcccacccttcmccctgaaaaaacctcagcgcatctmactgagagctcccccagccaccyccgtcaaggctgggacctctgcccaccattgggtattaaatctacccacctgctttagccacarctggtkyytacccakggayacctcccttactggcctgaagcctgaaccgtcaacccagtaaataaaatactggggaaaaattaaataaataaataaataaagtgcacaccactggggaacgagataagcttcaagagacctctgccattccaaccccacaggagacagtgaacycgctcacacaccaagcacattactactacaaccagcatctgagaaagccakcacacaaagactctctataaccaaggaactcatacagagtcttcacccctgaaagcacccagaaccaaattaggctacaataaactatawwcattaaagtcacatcctcaaggggaaaaaaaattaaaaagcacagtccaatcaaaaataaattcaaaaataattwgaa

SEQ ID NO: 361 - DNA, 527 bp, Homo sapiens
  repeat_region (1)..(527): l3
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
attatattcagttctgggtatcacattttaagagagacattgacaaactggaacatgtccagagaagagtgaccagaatggtaaagggtctgaaaaccatgtcatatgagaaatagttgaaggaactggggatatttagcctggaaaagagaataggggagacttagagggagacatgatagctgtcttcaaatatttgaagggctgtcatatggaagaggaattagacttattcttgtgcagctccagaggacagaacaaggaccaatgggtggaagttacagggaggcagatttcagctcaatataaggaagaactttctaacagtcagagctgtccaaaaatggaatgggctgccttgggaggtagtgagctccctgtcactggaggtattcaagcagaggctggatgaccacttggcagggatgttgtaaaagggatttctgcattggatgggggattggactagatgacctttaaaggtctcttccaactctntgagattctatgattctatctttcaggga

SEQ ID NO: 362 - DNA, 2750 bp, Homo sapiens
  repeat_region (1)..(2750): line2
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ctgtcattcattaccgntccttgttgcagtcatccatcgagcccggctcggtcactccctctcatttctcgaagaktttrtctcctagntcaactgtcactctctcataataatantcctgtcataattcttggtgatttcaatatccacatagacgatccatccaatactctggcctctcagttccttgacctcctctctcccgtggtcttgttctcctctacccactctcagccactcactcccatggtcataccctagatcttgtcattactaataactgcaactcctccataatctcaatttcaagcatccyactcttttaccacyacctcctatctttctagctcactctctctggtgccctaactccaataatyctttgaccccaccgagacctmcaatccattgatctcatatgcttttcactgtnccgtgtcctcttccctcctttcwttgctcagattccatggtcaatcattataatcactcccwtacanataccctcaactcccttgcccctytctcmctttgtcttacttrcttgncaaaaccacaaccctggttaaatccaactntccgactaatttrcgcctgcacccgngcagctaaacatggctgragaaaaatacacaaccatgctgactggtctcactttaaatttatgaccacgaacctcaagtgrgcccttaatgctgccaggcaattntactacatttccctagtccattcactctcccactctcctagatgactatttyatactttcttnyttctcaaacctccaacayyyyytnccatctttactctcagctgatgaccttgcttcctatttcactgagaaaatagaagcaatcagaagagaatttccacatgctcccaccaccacatctacccacctacctgcatctgtacccatatactctgccttccctcctgttaccgtggatgaactgtccgtgctcctatctaargccaacccctccacttgtgcactagatcccatcccctcttgcctactcaaggacgttgctccagcaattctcccctctctctcctgcatcatcaatttttccctctctactggatcattcccatcagcatataaacatgctgnnatttctcccatctttaaaaaacaaaaattctccctcgaccccacttccccctccagctaccgccctatttctctgctcccctttacagcaaaacttctcagaagagttgtctatactcgttgtctccacttcctcacctcccgttctctcttaaacccactccaatcaggctttcgtccctaccactccactgaaactgctcttgtcaaggtcaccaatgacctccacgttgccaaatccagtggtcagttctcagtcttcatcttacttgacctctcagcagcatttgacacagttgatcactccctccttcttgaaacactttcttcacttggcttccaggacaccacactctcttggttttcctcctacctcactggccgttccttctcagtctcctttgctggytcctcctcatctccccgatctctaaatattggagtgccccagggctcagtccttggacctcttctcttctctatctacactcactccctgggtgatctcatccagtcycatggctttaaataccatctatacgctgatgactcccaaatttatatctccagcccagacctctcccctgaaytccagactcctatatccaactgcctactcgacatttccatttggatgtctaacagrcatctcaaayttaacatgtccaaaactgaactcctgattttcccccccaaacctgctyctcccgcagtcttycccatctcagttaatggcaactccatccttccagttgctcargccaaaaaccttggagtcatccttgattcctctctttctctcacaccccacatccaatcyatcagcaaatcctgttggctctaccttcaaaatatatccagaatccgaccacttctcaccatctccactgcyaccaccctggtccaagccaccatcatctctcacctggactactgcaatagcctcctaactggtctccctgctyccacccttgcccccctncagtctgttctcagcacagcagccagaatgatccttttaaaatgtaaatcagatcatgtcactccyctgctcaaaacccttcaatggcttcccgtttcactcagagtaaaakccaaagtccttaccgtggcctacaaggccctatatgatctggcccccgcytayctctctaacctcatcttctaccactttccccctcgctcactctgctccagccacactggcctccttgctgttcctcgaacacgccargcwcgttcctgcctcagggcctttgcacttgctgttccctctgcctggaacgctcttcccccagatatccacgtggctcactccytcacctcmttcaggtctctgctcagatgtcacctyctcagagaggccttccctgaccaccctatctaaaatagcacacccyctcccccatcatgcccatytttcttaccycgctttatttttctycatagcacttatcaccatctgacayactatatwatttayttgtttgtttgtttrttgtctcctccacyagaatgtaagctccatgagggcagggattttgtctgttttgttcactgctgtatccccagcgcctagaacagtgcctggcacatagtaggcgctcaataaatatttgttgaatgaatgaat

SEQ ID NO: 363 - DNA, 419 bp, Homo sapiens
  repeat_region (1)..(419): line2b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tcccccttgctcactctgctccagccacactggcctccttgctgttcctcaaacacgccaggctctttcccgcctctgggcctttgcacatgctgttcyctctgcctggaacgcccttccccwctccttcancctggccaactcctactcgtccttcaggkctcagctcaratgtcacctcctccaggaagccttccctgacttcccaggccgagttaggtgccctcctctgggcccccccggtcctaccctgccactctgggttatmattgtctgtkngcangtctgtctcccccactggactgtgagctccgcgagggcagggactgtgtctgtcttgttcaccactgtatccccagcgcctagcacagtgcctggcacatagcaggcgctcagtaaatgtttgttgaatgaatgaa

SEQ ID NO: 364 - DNA, 1460 bp, Homo sapiens
  repeat_region (1)..(1460): looper
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ccttyagaayaycatcaggtcttgnannnnnttttatttttgagtttttahttgtaactatttdtaaggatattttatgncntttattctttcaaagaacwrargaaanatgnctgaataaanctcantnnagctngtanttaannatagnntgaganatcttnatgancctattttttccattttgctatttyatcttnctaggaattatttcatcattactaatcaattatttctaactgtgctnwtataaaaagactaaaataataagaaaatggaagaatgataaaacctcctgggatgaaataaataaatcatcactatgacatcatccttcagttttcttactgtgttgcccaaagtattgcattatctttcaagaaggtataaaagaagtctggagacaccatctttgtagtctttttttagctttcattgaacacagtcgagaattcagaatttttcattttctacccataatggcaaagagaaaaaaattgacagaggaagacatttcacaattattagatgaatcagaagatgaatgcaaagagacagatagcagcactctagactctaatgatgatggtgaaattgatcatataagtgaaatctcagactatgagtcttcagatgacgatatcctagatgaattttctcaaactcaagaatcgacgagtgaacaatatatttctaaggacaaaaaggaaatatggtattctcatccagttagtcattcaacaggaaggacttcatcacgcaatattttgcgacaagaacctggaccatcccattttgctaaaaggacatgtgacagtattctttcatcttttatgatgtttgtgcaccaaatttacttgatacagtttgtaagtggacaaatgctaaaggcaggtatgtttacaaaaggtaactggaaggaaatagatgaagagaaaaaaaaaatcattgaattgatcattctaattggtgtttataaatctaaaaatgaaaatgttttgcagttatggagcaaagaagatgtctctcttcaacaaaattatgagccctcaaaattttcaaaagtattacgttttgacgatgtaagtatggaagaaaagaccagaaataataataagctagaacctattagagatgtatttgaaatctggaatcagtatttacaagatagatatgttccaggttcatgcatgacagttgatgagcagttagttgcattcaaaggatattgcccatttcggatatatataccttcaaaaccaggaaaatacggaataaagaatggaattacaattttgggttataattcaaattaaaatttttaatgaagtttttttacaattccttaattcttcttctgtaaattattcgtaaaatgacttaaaaataaaaaaataaaaagagttcattggacccagatggtaaatggtgatgactgtttttccttggtgtaccgaggg

SEQ ID NO: 365 - DNA, 495 bp, Homo sapiens
  repeat_region (1)..(495): lor1
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaaaccgrcccaattgtcccatagaactgatgtttatrgtttttttgaataaacatagaaattgaccctcctggtcttaaarcttgaaacttacatttgtyttatctgagttccttcctcaggaaaccaacyntcaggcctcycaaawagtatcaargaactgaaactcaccagatcacyrcatccagacaatgagayrccagacccctcatycatcatgattgcctaactgaccacctgctkcctgttgaccaactcctcttccttacccctccctaattcctgttttcyyacacatagttacatttcttccctgctatataaaccccyaattttagtyngtcagggagatggatttgagactgatctcccatctcctcggctgcagcaccyrawtaaagccttcttccttggcaatamtyrttgtctcagtgattggctttctgtgcagtgagcagcaggacctagacyraacccctggtrtttcagtaaca

SEQ ID NO: 366 - DNA, 491 bp, Homo sapiens
  repeat_region (1)..(491): lorli
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gattttggttccctgaccgggaacgcattgctcgtggctcggctgctgtgggccgggagtttcagaagccctcctaagcagctgcccatcccatttttggccggaggtgagtttctgtttctctttggccccgccgctgccagccccaacagtgttcctgattgcctaggaagaacagtctttgaaatttgacatctgcgtctagatggatgagtgtcttttgtgggtaccagacagcgggatctgctcctctcaatttgggaaattctgaaggaatttccgtttgcaggttgaacaagcccaaccgactgagagaggaagcaccccgactgtttcagtttggacactcttggggcttgtttgttgctgcagcagttggattgcgttttggtgattgtgtgcgtgtgtgtgtgtgtgtgtgtcaatatagtcacgggaaattagaatttgataaacggatattcttttataatactgtttggccccactat

SEQ ID NO: 367 - DNA, 498 bp, Homo sapiens
  repeat_region (1)..(498): lsau
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cgtcggaaggtgttgggagagcctcagccggaatttcgtggacggacaagggcacagagagcccagcgggctcccttgcatgtcagccggggtgcacaatgagcacaggtctagccaggaggccggcaaagagagctagaggtctgcgttccgccgccaggctctccatggtggcagctgggaggatgcaggggcatgggcgggccggcgacgttgcacggagacgcagaggaggtgagtcactgggggggtgtcaggcctggacgctgtgcgggcccagtgttttcgcgggaagagggtctccacccagcccaggggaggagcgcattttcagggggttggtggtgaggctggggatggtgtgctcaggcaggggtgtgatggaggaaaggcaggagagctctgccctggtgctcccgctgcccaggcggctaacttgcaaacccgcgcatgtgcagaggcagctcacctgtgggtacctgggccggctctgggatc

SEQ ID NO: 368 - DNA, 785 bp, Homo sapiens
  repeat_region (1)..(785): ltrl
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgatacggacaggrgrgggaartgctgggtagaggagggcgggktccctggctagggctccaccctcgggcctgtgcccacggacctaggtgaggacaggcatttytgttttcccgcccaaatgttgcatttyccaagaccacccytggcctgccacgccccccatcctgtgcctataaaaacccgagaccytagcrggcasasacacaagcggctggacgtcaagaggaacacaccggcggaagaacacactgacggtggcgccggcaggccatcgactggcggaacsattcgganttcggcaggggcggycggaggacagctggarracagccaggccgctgagcggccggactccaggggaaraycaccttcccactccatcycccttccggctcccccatctgctgagagctacttccactcaataaaaccttgcactcattctccaagcccacgtgtgatccgattcttccggtacatcaaggcaagaaaccccgggatacagaaagccctctgtccttgcgacaaggcagagggtctaactgagctggttaacacaagccgcctatagatggcaaactaaaagagcaccctgtaacacacgcccactggggcttcaggagctgtaaacattcacccctagacactgccgtggggtcggagccccacagcctgcccgtctgtatgctcccctagaggtttgagcagcggggcactgaagaagcgagccacacccccatcgcacgccctgtgagggggacaagggaacctttcccatttca

SEQ ID NO: 369 - DNA, 609 bp, Homo sapiens
  repeat_region (1)..(609): ltr10a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttaagtacggtgagttctgagatcctctccaaagaaccagtatgtcagtatgttcagctcncctgttctttgttctccattttaaagtttaacttcagtatgttcagctcncctgttctttgttctccattttaaagtttaactcaacagttctaatcagtagttaacgcctgttcccctggtcacctgctccatcctgactcatcccgggtcacctgctttgacctgagtcacccttagtcacctgctctgtaaccatccttcccgccaaactactcaccccgccactctggctcatacccctgctctctttaaaatagccaatcggaattagcttagactgtgcggtccaaccctagccaataggggaacgacacagcagtaggggctacctgcatcaggaataagaaccccttcccctcccttgtccaggtgtgctctcgccattgctccatctgcgagacgcacccttctatagaagtaaaattgccttgctgagaaaattaaatttatgtttgagtgctatttcttttgcggcaccgaaacgaaaattaaatttatgtttgagtgctatttcttttgcggcaccgaaactttatttataaca

SEQ ID NO: 370 - DNA, 510 bp, Homo sapiens
  repeat_region (1)..(510): ltr10b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttaaatacagtaagaaattcttcttcaaaagtttagcctgcttaagtttccttgtcctttgtttcctgctttcaaggccagacttccttactctctgtgtttcccctaccctggtaaacaaccttcctgccagtccttacccatacagcccacattccacatctgctacccactctgtgatttacctctcccgtcgcaatagcctctcccaccaaaactgatcttcccgccttcccaccagtgcaaccacattcctgcactttgcaagttagccaaccgggttcggattgtgcagtccaactccagccaatggagtcaggacacagtagcagggacaagctgcgttagacataaaaacctctgctttcctttgtttagggtgctctcgtggcaaccagacttaccaggagctctattctgcaaaagtaaatttgccttgctgagagaccctttgtcctttggctcagtgttggttcttctttgcagcaccgagcatttgtttccaaca

SEQ ID NO: 371 - DNA, 586 bp, Homo sapiens
  repeat_region (1)..(586): ltr10c
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaaaaagtaaagtagaggttcctcttcaaagactttcctccccatctaattaggaataaatagtaacttctcttaaaagcaaaatttattcaaagacctgtgctaacattcttaaatatctgctagccataataaagaaatcaatgtactttatattcttagctcccacaatttagcctaaatatttgccctggcatgcttatactagtccaagcaagcattaggtcatagcctgttcctcttccttatttgaaggtgtttttacctttctcagcattccacaagttacttcctccttcctttgttctcctctgcctttgcctcttttaaaaagttctaagttgctagccaatcaggacaaatacagaatgtgaggtcctgttccagccaatagaaactggacacagcagtagggtggacgcgtcaggttataaatgaccctgtctcctttgttcagtgtactctcatggcaaaactgctggtgagtgtaccctttctgcagaaagtataaawatggccttgctgagaaaattaaatttatgttcaagtgctatttctttacagcaccacaagcatttcaaaca

SEQ ID NO: 372 - DNA, 513 bp, Homo sapiens
  repeat_region (1)..(513): ltr10d
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgggatatgatgaggtttctcttcaaataacctgatcaatcttttattctttaattcatagtacccccctccctycttttttcytttttctccttttttcctttttgcctttgttagatgcccaggcacgccacagtaccaggcgttatcaataccagctcacattcctttccttatttggaaaaaagactaactttctagctcattacagacaccccttcccctttcctctccgctttcttttacgtgcccaccttatctaaaaaaaaatcaaatgtttagccaaccgggattagtttagattgtatgacccaaccccagccaatggggaaagggtacaagggcaggacttgcatcaraaataaaggctctcgtgcccctttgttcaggtgtgctctcatggcgactggccaaggagaagcacccctctgcgcagaagtaaaattgctttgctaagaatcctttgttcgagtgttcaatttccttaggattttgagcgttattcctaaca

SEQ ID NO: 373 - DNA, 684 bp, Homo sapiens
  repeat_region (1)..(684): ltr11
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgtttctgcaggatgtacagccctcccagcacggtgctcgcttccctaatgccattccacagtatttgttgcagagaaggaaggcagcatgccaggacagatggagacaggactaatttggcctgaggtatgtaattttgaacttgagcctctctctgggactgtaaaactccaaatcaaagctaatctgagaatacatacatctgaaagatgattaggactgtaaacatctattaatattcaactctgatacaaagtacaagttgtttattcttaccacgcaaggccaaaaaaggggagaaaaaaaaaaaagcacacagcatatgcactggaaagtttcgcttattcaaaacagtatttgtcaagcacctccagtctggtgctgcaggggaaacaaagattaaacagccaggcggacactgctctgcttccaaggtgcttacggtcttaagaaggagacaagacatgtttataaatagccaaaatgcaacccagaaaaggctaaaaaacactgagagggagggagaaataaacgaagcaagaggtctccggaggaagagatgaatgaattagcctattaataactccgtcactgtaatcccaatgtaaagcaagaattccaaaccaggaaaggtcaaactgaagtatttgaggaacacaggcgtcgcctaagcccttcaca

SEQ ID NO: 374 - DNA, 877 bp, Homo sapiens
  repeat_region (1)..(877): ltr12
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtatctagttaatctggtggggagttggagaatctttatgtctagctaagggattgtaaatacaccaatcagcactctgtatctagctcaaggtttgtaaacacaccaatcagaaccctgtgtctagctcagggtttgtgaatgcaccaatcagcactctgtatctagttaatctggtggggacttggagaatctttatgtctagctaagggattgtgaatgcaccaatcggcactctgtatctagctcaaggttgtaaatggaccaatcagcactctatgtctagctcagtgtttgtaaatacaccaatcgacactctatctagctaatctagtggggacgtggagaacttttgtgtctaactcagggatgtaaatgcaccaatcagaaccctgtcaaaatggaccaatagctctctgtaaaacagactgactttctgtaaaatggaccaatcagcaggatgtgggtggggccagataagagaagaaaagcaggctgcctgagccagcagtggcaacccgcttgggtccccttccacactgtggaagctttgttctttcgctctttgcaataaatcttgctgctgctcactctttgggtccacactgcctttatgagctgtaacactcaccgcgaaggtctgcagcttcatctgaagcagcgagacacgaacccaccaggaggaacaaacaactccgatgcgctgccttaagagctgtaacaccgcgaggtctcgagcttcactcctgagccagcaagaccacaaacccaccagaaggaagaaactcaggaaaacagccgaacatcagaaggaataaactctggacacaccacctttaagaactgtgacactcgctgcgagcgtctgtggcttca

SEQ ID NO: 375 - DNA, 1030 bp, Homo sapiens
  repeat_region (1)..(1030): ltr13
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgggccgcaagccagggagctgcccaggcaagagcctgaaggcacaagctgttccagtacagcaaagaaaataattagaataagaaaagttttactagagataggaaacggataggattatatctgactattattaatcattagtttgtagcatcactctttgttctattaccataatgatctctgttctattatgattaccttgggggaaaccaggccacacagagttaggagctgaagggccacagtgagaggtgaccagaagacgagagtgtgagccctcattcacgcccagagaagggccgctggagggctccttggcctagcggtaatgccagtgcctgggaaggccctggttacttagcaggccttggtctagcggtggccccagtgcctgggaaggcacccgttacttagcagacccggaaaggaatctccctctctccaggggagacagagaacgctccgctccaccacctcttgtgggaggtctgacattagccaggccgggccgagtcatccggaggctccaacgtctgtctccctgtgatgctgtgcttcagtggtcacgctccttgttcactttcatgttcagcctgtgcacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtggacacgtgactcgcgtgacctatcgatcattggagatgactggcactccttaccctgcccccttgccttgactacaataaatagcagcgcctccaggcactcggggccactacctgtctgtctccgcgctttggtggcagtggtcccccgggcccagctgtctttcttcctatctctttgtcttctgtctttatctcttcgatctctcgtctccgcacacacgcgaagagaaaacccacagacccggtaggggtggaccctaca

SEQ ID NO: 376 - DNA, 548 bp, Homo sapiens
  repeat_region (1)..(548): ltr14
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttgggaaaaggacttgtggggtgcctgtataaactggccataaaaatatgggacaataagttgtggaaagccacaagaggcctctgaggagaaaagcctcctaattgccacgctcagagcgagacctgctctctcttatctgtaaacactgtattcaaggagaaagaccctcctttgaagcattggaatgtggacagacgtgcaggctcctagttaagcccactcccactagctactctccgataagttaaagatatgctgtttgagcacaaaggagattcatttaaagcgcttctgctgtagattatgcctgtgacgcactgctaccctttcactgttttgccctgaacatctgcttcttagatctaagttattgtactcaataaatagtgtggagaccagagctctgagccttttgcagcctccattttgcaattggccccctggcctccactctttatgaactcttaacctgtctcttctcattcctttgtcaccaccagacttcaggtaccctacaggtggtgttgaggctggtccccaaca

SEQ ID NO: 377 - DNA, 344 bp, Homo sapiens
  repeat_region (1)..(344): ltr14a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgggagaaaagctgagtgttgggagagaagctgaggcagggcttgcatgtctgctagacttgctggctccttgcttctagcactcccattatctcaagcagccatatgtttctcattcacttgatacactgtttcctttcaacccccacatcctcaccacctgtttctttgtttgagcaccaataaatagcgtgggctcccagagctcagggccttcgcagcctccacactcgcgatggccccctggtcccactttctctctcaaactgtctttttctcattcctttgactccgccggactttgtcgcccccacgacctggtgttgggtctgatcaccccaaca

SEQ ID NO: 378 - DNA, 608 bp, Homo sapiens
  repeat_region (1)..(608): ltr14b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgggagaaaagctgagtgttgggaaaagctgaggcagggcttgcatgtctgacataatgtaaaagagtcttggaacatgtccggggtccagggtctaaaacccctcgtggcctttggaacaccaagctctgtgctaaagggtggaaggctaccctgacgcaccataatctaagcccagggcataaaacccctcgtggcttggatagaatccagggctcgtggcctctggaatgtgtctagacttgctggctccttgctccttgctctcccaggatcgattgtatcttgagttaaaagaacctgctctccattatctcaagtagcagaacatgttccatatgcctcaaaggaaatgctaaaccatcacagctgtagatcatgcgcttaatgcaacttgccctttcgacccccacattctcaccacctgtttctttgtttgatcaccaataaatagtctgggcttccagagctcggggcctttgcagcctccatacttagcgttggccccctggacccactttctctctcaaactgtcttttctcattcctttgactccgccggacttcgtcacccccacgacctggtgttgggtctgatcaccccaaca

SEQ ID NO: 379 - DNA, 587 bp, Homo sapiens
  repeat_region (1)..(587): ltr14c
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgggaaagagagtttctggggtgccagttgagttggtctcccctgtgtgagacacccatgggaagccatgggcggcctctgaggagaaaagtctccttattgccttcatgtctttatgccccgagagcataaccgctcagcggcattccacaggttgctcagggagataacactcccttgaagcagtggagtataatcaaacatcttggctcctcctgaaacccactcccacccgtttcagtcccgataagttaaagatcttaagtagtttagacacacgcctttgctcaaggaaattcacagaaaccgccactgctacacatcttatcgaatgactcacgagttctccttcactgattaatccttttcctcatcccttcctccccctcccatctgccctaagaacaaagagcttgtaaaccaataaattgggtggagcccaagagctctgggccgtgagcaagcctccgatgctctggtcccctggacccgccttttaaacgcttattctgtctctttctaactcctttgtctccgccggactcggggtacccactgggtggtgtggggctggtttccccaaca

SEQ ID NO: 380 - DNA, 493 bp, Homo sapiens
  repeat_region (1)..(493): ltr15
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tggaacaggaattaaaagaaattaaagaatgcataagcaaaaactcaattgtatgtagggaaacccaattcctcctgaggaagagaaagaggtggagtcctttaaaaattcactgcctgtttttccgtctgtagctagtgagccttatctctccctttcccaggcattgtgaagaccctgtttctccagctgtgcagctgcatggtcactagacagataaactcaagttgtaaaacatgtttttccttgaaaagtaagaaatgatgtaatacatgtctcaactgaataactgtctttgtttctcacttctgtagtaagcttccccctgcacagatctcccctctcaccccatgaaatgcttaaaaggtaacctgactctttgttcagggctcagtcctttggatgttaatctgactgggctggtgcacctaaataatamatayatcctcctcaaccccatcggtctctctgattcctaaatcatccccaaaca

SEQ ID NO: 381 - DNA, 450 bp, Homo sapiens
  repeat_region (1)..(450): ltr16a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgacggacatgraggtgcgctgcccagatcccccttcaagaacggaartyttattncccyagctgctgggagwgctgtcggcagacagccctcagctgtcagccccttcaggaattgcctcngctgaagagagccgcctcgcccaaggtcacgccccctccccggggcagcccacatccaatgactgrtcaatrtggaggtataaaggcccggccctctcgccccaactcgggacaactctgaagggccatyccagctccagagctccccgtggggtcggctgaggcctttgttgcgactgcattgcagcccaacttctccctctgcccaatcctgcttccttcccttcccttccacaggcgttgatcccaagggcgctccctaataaacctcctgcacgctaatctccatctcagagtctgcttcccggggaacccaacctgcaaca

SEQ ID NO: 382 - DNA, 457 bp, Homo sapiens
  repeat_region (1)..(457): ltr16a1
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtagtagatgctgttggtgccctgcccaggtcccytttmtcgggctagtgcatccattccccagctgctgtgagtgttggctgctaatggctcacagctgcccccttctctggagaattgccctcagctaataggagttgcctcacctgggaggttaccccccaccgggcagcccacagccaatagactgactgatacaggggtacaaaagcctagcycccttgcctcaaggtgggacaactcactctgtggtgcaattcatgctccagagctccccatgggatcaggctgaggctagacttcagctgaaaccacatccttgcttagcttcttcccctgccctatcctgcttccctcactcccttacaagtttctcctgagagcactccctcaataaatcacttgcacaagaatccctgtctcaggctctgcttctagggaacccaacctaagaca

SEQ ID NO: 383 - DNA, 387 bp, Homo sapiens
  repeat_region (1)..(387): ltr16c
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgcctgaggrctttctctggccastgaagccagmtttgtcngcccacgtggcaagccggaaatgctggggagttaacaccccttggaagcagccctcaaccaatgasagatggggagttggtggataaataccccagcttcctcacccctcagkgggataactctgaggtatgtgttctacactgtctcccagagtttcccagyrggaytgagccccagttgcccacagtggtaacttgmtaatatacaytttattggcttccttctctttcctgtctcacttccccacttccctacyagtgtttcctgggatcacctcccaaataaactacttgcactcaaatccttgtctcagggtctgcttctgggggaacccaaactaagaca

SEQ ID NO: 384 - DNA, 464 bp, Homo sapiens
  repeat_region (1)..(464): ltr16d
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtggtggccatgaaaatgtgcctctcagatctcctgctgcagggagcatagttgactgacggccccagctgctgtccyttggratccaccactgcgtttgcaccaaggccacgcttccctcaggctactcccagccagtgactgagcacggcaggggtgctaatgcaggcccgttcctgsnagatgcgggactcctccgacgggcaactttggctcgaggactcctcatcagcctggttgaaactttcttagaactgcactgcagtctgaggctcttcctacccaatccttcttccttccccctctcctttcacaggtgtcagacctgcatcatggtccgaagtctctcctngcccgctcctgctccctccccttttatctttcacaggntttcccctaataaatctcttgcacatttaaccctgtcttggcgtctgcttctcagaggacctgaactaacaca

SEQ ID NO: 385 - DNA, 780 bp, Homo sapiens
  rerpeat_region (1)..(780): ltr17
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagagacaggactagctggatttcctaggccgactaagaatccctaagcctagctgggaaggtgaccgcttccacctttaaacacggggcttgcaacttagctcacacccgaccaatcaggtagtaaagagagctcactaaaatgctaattaggcaaaaacaggaggtaaagaaatagccaatcatctatcgcctgagagcacagcgggagggacaatgatcgggatataaacccaggcattcgagccggcaacggctaccctctttgggtcccctccctttgtatgggagctctgttttcactctattaaatcttgcaactgcactcttctggtccgtgtttgttacggctcgagctgagctttcgctcaccgtccaccactgctgtttgccgccgtcgcagacccgccgctgacttccatccctccggatccggcagggtgtccgctgtgctcctgatccagcgaggcgcccattgccgctcccgatcgggctaaaggcttgccattgttcctgcacggctaagtgcctgggttcgtcctaatcgagctgaacactagtcactgggttccacggttctcttccgtgacccacggcttctaatagagctataacactcaccgcatggcccaagattccattccttggaatccgtgaggccaagaaccccaggtcagagaacacgaggcttgccaccatcttggaagtggcccgccgccattttggaagcggcccgccaccatcttgggagctctgggagcaaggaacccccggtaaca

SEQ ID NO: 386 - DNA, 358 bp, Homo sapiens
  repeat_region (1)..(358): ltr18a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaaggaaaatggmtgtgctkyrgtcaaggaataggccaaggcagacatccggtscagcatgactcagtargtttggagtgcaggygcacaacyccackcattatgtaaccayrycdcatgarrcgcatakgtaatcacycacrtgagctcatacttggctcggagccactattgtctgtraaaggtataactgccctgctgacgctgtgcacatggctcgcwyccacccagagagagaataaagccatgtctcaactgcctacggtccctcgagtgttytttcagctacccgccacycatccacccactcccctcggacctcagcttaggctggaacctgacacttggctntgaca

SEQ ID NO: 387 - DNA, 603 bp, Homo sapiens
  repeat_region (1)..(603): ltr18b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaaggtatatggatgtgctctggtcaaggaataggccaaggtggacatctgggccagaatgactcagtgagtttagggtgcaggcgcatactccacttgttatataacctgtttgtgtaagctcatactgggctcggagccactattgtttgagaaaggtataactgccctgctgacgccgtgcacagggctyktgcgggcgcgcccraagaaaagagagagagccagagttgtccatcttgtagacggacaagggggagccagggctcggctcgcttgccacccagagaaawgagttaagctgctaaccctgtaagggagagcctaccttgtaggccagggaatgcagctgtgtgtgggagtggcaggagctgcagagctggagcagacagccgagataaaggtagacagtgtgagagagctgctgcgagagagctgctgatgagagagctagtgtgagtgagctgctratgaaagagctgctgaataaarccatattcactgcctacrgycccyygagtgttctttcagctatttgtcgcccatccacccactcccttcggacctcagcataggctggaacctgaccctgggtgtgaca

SEQ ID NO: 388 - DNA, 486 bp, Homo sapiens
  repeat_region (1)..(486): ltr19a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgacagagcaggagcatcgccatcttggacaagcactgccattttaaagttccccttgatcaaaaaccgcctaaatccaacccaaagggcatcagcctaatggctaakgtcagcatgaccataaaccacaaatgacatctccgaccagaaacattccaaccctaagataaacccctcccyraccagagacatgccagccccgagataacctcccctccggccagagagatgtcagccccaasataacctccccttcaaccagagacattccaaccccacaataaacttctcccccacacagaaacattccaagcctgtgataaagctctctcaccctaaaacccttaaatactcttagtctgtaagagagagtgctcctgactgaaatcggccagaagcccctctcaggtttattctccaaaataaacctgtctttgactgttgagccgcttttcrtgtttctttcctctttctttaactcttaca

SEQ ID NO: 389 - DNA, 580 bp, Homo sapiens
  repeat_region (1)..(580): ltr19b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgacagagcaggagcaccatcatctcggacaaacactgccattttaagttccagctccttttccagcctyatgcatttcaaggaaatcactttycttctaactacaagcagccagaaagagcagacagtaaaatacagataagacagctcgggcacagagggaggtggkrggaaagtctcttgggtaactgccaaacttyaccctcatacaatgggccccagtaaaayagkgggccttaataagcacattcctttyccttcgggtwcactaagatarggaagctaaaagcagactcagggaggcggcggggggtatgcctgcagctgcakraagatrtatgggarcagacayacaaytstccctcccagataagcacaacaaagagacacagaagcagtccaagcctctrataaactctctcaccctgaatccttaaaaactcttagtctgtaagagagtgtgcctctgacctaactcggccagaagcccctctcaggttcgttttctctaaaataaacctgtctttgttgactgkwgagccgcttttcgtgtttctttcctctttctttaattcttaca

SEQ ID NO: 390 - DNA, 826 bp, Homo sapiens
  repeat_region (1)..(826): ltr1b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgatatggacaggagacagggaaatactgggtagaagagggtggttccccagcaaaggccccaccctcaagcctggagacctgcggccctaaatgggaacaggcattcctgttttcacgcccaaaaagttgccttttggcccaccacaccccctatcctgtacccatataaaccccaaaccccaggctccagaagcagannagcagacaaggagaggagcagangaggagacgagcagaagagcngcagaatagtgcggcagagaagagaaggaacgtctgaacgccgagaggagttcrgctrgggrcrgtcagagargagntcagccgctggayngccaaactccaggggaagatcatcttcccactccatcccctttccagctccccatccatcccactgagagccacctccaccactcaataaaaccccygcattcaccatccttcaagtccatgtgtgacccgattcttctgggatgctagacaagagcttgggatacagaaagctgtcacactggccctctgcccttgcaaaaaggcagagggtccactgagctggttaacacttaagccatctgtggacggcaaagctaaaagagyacactgtaacacatgccnnncccacttgggcttcrggagtcacaggcacccacccctagatgctgccatggggccagagcccaaaagcactcaccccagctcctgcwcctgcccgtctgcatgctccccctcctgtaaggggtttgagcgtgtggcgaccnaacagrngagccacacccctgtcrcatgtcctgcragggggrtcagggaactctcccatttca

SEQ ID NO: 391 - DNA, 449 bp, Homo sapiens
  repeat_region (1)..(449): ltr2
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
taaggaaggagaccacctctcccattgtctcctgtttcatgagaaagcaaaaagttaaaaaaagaagcagaagtgagatcaatggccagatggtttagtgccaagaaccaggcctggtagttaaacatcaactcctgacctaaccgcttgtgctatccatagattccagatattgtatgaggaagacttgtgaaactttctgttctgttctgctagcccccatcactgatgcatgtagctctcagtcatgtagcccccacttgcacaatgtatcatgaccctttcacgtggacccctcagagttgtaagctcttaaaagggacaggaatctttactttggggagctcggatcttgagacgcgagtctaccaatgctcccagctgattaaagcctcttccttcatagaaccggtgtctaagaggttttgtctgtgactgttcctgctaca

SEQ ID NO: 392 - DNA, 512 bp, Homo sapiens
  repeat_region (1)..(512): ltr20
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tggtawtgaaaggagttagccagcttgctttaggcagacagtaagggaaagggtccccagagaacctccgacccgccccacaagtgtttacaccagatgttttgtgcagataagggaacttgcacagggggcttgcctaracatkcccacagtgaaaaattttwttcyttaacacatgckcagtaagaaaaataaatcaatatggagtagctcagactragggccyacatgcgcactggaaggatggggtggagccaccaggaattcgcaccttatgcaaatrrggaaccagcctcatcagcttytstataraagcyctkgtattcaactgtgaagtggcaaccwgmaacctgctttcaggacccctctcttttgctgagagcttttctcttcctttcgcttaataaattctgctcyacctcacccttcaatgtgtctgcatgcctaattcttcctggtcatgagacaagaacctggatytagctgagctaaggagcaaaaaccctgcatca

SEQ ID NO: 393 - DNA, 569 bp, Homo sapiens
  repeat_region (1)..(569): ltr20b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagagaggagaaaggaagaaactggtcaggcaggcagttagggtgggtcctcggttgaattctttcaaacaaaagaacagcctgcaggcacagataagggaacttgcacaggggggcttgcctaagacatgcccacagccgcacagataagaaaggctacacaggagacttgcccagacatgcccgcaatggaaaattccgtcccctgacacatgtgcagtaaggggaacaaagcaatatggagtaactcaagctaagggcccgcatgcgcactaggaggatggggtggagctaccagaaattcgtgccttatgcaaatgagacacccagccctcatcggtttcttataaaagcctttgcattcaactgtaaaaatggcaaccctcttccgggccccctctccgcggcggagagctttcttctttcgcttattaaactttcgctccaacctcaccctttgtgtccatgctccttaattttcttggtcgtgagacaaagaactccgggtgatacctcacaaggagagactgagagactgctacattgtggtgcattggcgagactaaca

SEQ ID NO: 394 - DNA, 505 bp, Homo sapiens
  repeat_region (1)..(505): ltr21a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttagggacaaactgcccccaagaaagcttcttggtgctgcccacccctccccgcaaacctctccgcgctgcccacccttcccccaagcctytttacatttctaagcccttatctaggcaccacggtgaagccagcctgatagaagacttyacytatcagrccttgctgcaataaagcaaaccccaattacaaaccatccggaccgcacagggggaggtcgtgggaarcataaacaaactttacctacaccctccngtaccgtaaacgtcacaaggtgatatgtggcaraattaaccagcaaacaaccccgggatgcrgccataccaaagractccctcaaactccctkccccaatrtaaacccctcattctgtaagcttggggctgcttyccttgactgtkawgggggcagccgrcaggttaataaargcttgcctgaacttggggctctctctctytggtcctttctctcggctraccttacattctcactctctaagttca

SEQ ID NO: 395 - DNA, 438 bp, Homo sapiens
  repeat_region (1)..(438): ltr21b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgttagggtcrcccyraycagacyrytcccttcccctcccacaggmcttacaatayrgtccyttgyrctctccgcacagctaccccagggcaaaaracaaaycccccttcactgayccytccagtaactgtscrgacagttacaggatgcggtyaacatrtctgttcacctcgcataacaaagctggcaaaaaaacatctccaggatgcrgacaagwcacytgcacccyygactcactcagctccccsacccyracccagttctcctgcacccccaactcagctcccgcaccccgacctrgttctggccctataaaarcctgctatwgtctgtaagyrggkctgcctcctyyaactgtggtrgagcagccaagcagctcaataaagcttgcttgcctgactttgggtctcytcatcctttctctcggctgaccttaca

SEQ ID NO: 396 - DNA, 580 bp, Homo sapiens
  repeat_region (1)..(580): ltr22
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtdgggrttcastcaggvtggtggsagaaatattaaagggaaatattagggaaagttataggaaataghcacaaaccttcttggaaggcctgaragtttgcawaacttcrgtaatagathtggctgaaggcagccarttcccttaccttwragcattarakcatagggtaaatacwaaggaawatagaggcttccccagttaagtctgtttaycctacytccattaactagcttgttkastcakgtggtcctmttggggmaggtcgaccagggatattgccccstaatggtatttacttyagaccwgggtgcctragctttaatcattactwgggstactctcttaacmatgtyaattacccwcwagtgtgttgactcaaagcctttgtyawtwaatctatactraataaatgcctgsagtgcyagctgnttagggccagcwgcwgtkacaaacctyycttggwgtstgtaagcggcctggacactcagctggactggcaaagcagaatatctgtgtgtcagtgtacrttttattcatccgtcatttgggtcagggtctgcgggtgacagacccccaca

SEQ ID NO: 397 - DNA, 458 bp, Homo sapiens
  repeat_region (1)..(458): ltr22a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgggagatcggtcagagtggtgggaaaaactatagggaaaggacgcaaaccttctgaaaggtcagaaggttctgcagagccccgggggagaatagctgaaggcagctgttctataaccctgaggcagagggcaaggagtaggtacaagggagtgtaggggaatttatcttaaacaggcttgtttacttatgttgaccaggaactgacctttgatcatccgcgcgcgtgacgttccctgaaaggggaacaataaatgttaattacccgcaggttgtgtttgctccaggttttcggcattgtgcctgcactgaataaaagcaagcagctccagcttctcggggctgctctctggccactagagccaggcagtcacctagctgctcttacgctgcatacctgtgtctgagtactcatttcatccatcggtcggccagggtctgcgggacagacccggca

SEQ ID NO: 398 - DNA, 492 bp, Homo sapiens
  repeat_regionq (1)..(492): ltr22b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaggggttcagtcaggctggtgggaaaaatattagagatagttatagaaatagacacaaaccttcttggaaggccgggaagtttgcataacttcggtaatagatctggctgaaggcagcctaatccctttacctttagttaaataaattagagtagaaacaaaggaatgtagaggagtttatctagmtagcttgtttactcatgtggtcytaagactaacctttgatctacngcaggtgcttaattgctttctacttgggaagtccacaatgtcaattaccctctagtggtgttgactcaagcntttgtcaattaatctttactgaataaatgcgagtctcactggctggtcggcaactgtttacagcactctcctgggagtctgtaagcggcctggacmctcagctggactggcaaagcagaatatctgtgtgtcagtgtactttattcatccgtcactgggtcagggtctgtgggacagactcccaca

SEQ ID NO: 399 - DNA, 437 bp, Homo sapiens
  repeat_region (1)..(437): ltr23
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagaaaagaaaaaatagctyagagcagtctgagctatgtgaggtatgcaaaatttatcaggcccagagagacatgagtatgggacttcagtcatgtccctactccccctcrccatgcccgggggcaattgtttgaaggcattttgttcctgactagctgcctcatccattatcttcatgttcctggaatttgtgatacaaagaacaatgtatagccaatcaatagcywatgttattttaatgtaaattyytggtaaacaacttaaggaactscctcttctttttttcctttaaaaaccacttgtaactgctgctaattggagtgtatattcagggcaacttgaatctatgctcccaggttgcagtcctcaagcttggcccaaataaactctctacttatattaattttgcctcagctttttccttttaggttgaca

SEQ ID NO: 400 - DNA, 490 bp, Homo sapiens
  repeat_region (1)..(490): ltr24
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtraaattaaataattcaaacttaaagctgttggaacttkaaattattctgagccttgagaggaatgtggctatgcggcctgagtcatgtagcatgcagctgcaacttctgcttytctgatttagattancttttttccttattcctgtactgtaaatrattaggaagaccaaatggcgccagagataagaccccctcagatcactaccccttctcacagaatgataaagyaatcttccttggaatgtagcaakctgtaaccaatcaaatcgctgtaacatatgcactggycttgtatggaaaatgttgtaatcctgctaaaatttctctgtctctgcctatataagtgaaaccttaacttctccactttggaacgctgaccccattcctttggagtctgtgtttcctgggtggccatcctcaagctttgcgctcgaataaactctatacttaatcatattttctgaatctcattatttaaggttgaca

SEQ ID NO: 401 - DNA, 576 bp, Homo sapiens
  repeat_region (1)..(476): ltr24b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaaantaaaataaaatttcaggaccctctaaatttattatgccaagggggaagttaagccctggagactgagtcagtagcatgtttgcaattctgtttcttagattatagattaactctcttcctcattgttcttgttctgtaaatgactaggagagaccagagaccagacctcccnccagctyccnttccaatcactgatctttgttatagattaactgcctcctttattgtcctgtacctaactcagaccagatggtgcaaaagaccccatgactgttacatcttcagtgtggaatgttaaatatacctttcccgaaagaaaaagaccaccttaactaatcagattgttgtaactatgcattaagccttatatagaaagatgttgaaattctgttaagcttccctaaactttgtctatataaatgatcccaaacttctacacttcggaacactgacttccattctttggaatctgtgyttccngggtggnccatcntcaaactttgcacttgaataaactctctttaaactagattctgacccttttgattattttaggttgacagtgcyta

SEQ ID NO: 402 - DNA, 794 bp, Homo sapiens
  repeat_region (1)..(794): ltr25
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagaggagttaactaacttgccttaggtagacagcaagggaagggtccctggagagcccctgacccacgggtcagtgcctcatccccacataacataaaaaagcagcctgggaaaaaaaatcaagctgcaggcaccaataagggaactagcacagggggttgtgcctggagacatgcccacggctgcacagataggagaacctccagcccattcagataaaaacttacacaaacctccggctcactcagataaagaaacaaggcctgacataraaatgcctttgtcctttgtataatcagcgggctcccaggaaaaagtttcttctccttttgtgggcatgaacacagtgggctctggtgggttccggtggacactttcctttcctttttttggactgtaagcctggcctctatgaatcatcacttcagctcctgattgrtcccgggccaaggtcctgggccaaactgagtagccnctgtgaatcatcacttcaactyctgattggtcccaggccaaggtcccgggccaagctgagtcacacgttctccaagacagcccacagactaaacacattccttccccttcccagtccataaaaaccccagaccccagcctcatagkggrcaacccattcgggtccccctctccgctgrcagagagctttcttctttcacttattaaactttcactccaacctcacctttgtgtccacgctccttaattttcttggaggtrrgacaaagaactctgggtaytatctcagacaatgagagactgctacatnttggtgca

SEQ ID NO: 403 - DNA, 603 bp, Homo sapiens
  repeat_region (1)..(603): ltr26
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaaaccgtccctataaactttataaaattaatcagggaagaagrgagggggagaaatgaaaataaaccaagcttgcagcacattcagcattaatcatkaggtcagcttgctctctgacctgcttcctcatagttgtttggtgcctattgcctyagaatcacgtagaccctgttacaagattatagttccccttaactgctctatagataacaacttgaacattatgaaacgttaagttttccctttgagatattccttcgggtcctgcataccgatgaaactactgacaactgacgycagctggtctgaaggaccccacgaggagctgactcaccaaagaatgcagtttccacatcctgatgatttcatcccccttaccccgaccaatcaacaaccccaattttccagcccctcgccctccatgatccccttaaaaaccccagcccagaactcctcggggagatggatttgagggtctcctcccatctcctcgctcagtgccctgcgatcattaaactctttctctgctgcaaaccctgctgtctcagtgtaattggtctgttactgcgcagtgggcatatgaacctgttggtcctataaca

SEQ ID NO: 404 - DNA, 622 bp, Homo sapiens
  repeat_region (1)..(622): ltr263
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgaaaccatcctcacagggctaacaagaattacatgccgggttctgggcagaaatatagttataattaagcattaatcaggctgcactttggcccacttccttgtaactaaaagtcatgtagcactagatactgaccatttgcatccccattgttcctatagataggatttctgaccttagaatcataggtttttgtttaagaattgatttgcatccccattgttcctatagacaggatctctgaccttagaatcataaggcttttgtttaagaattgcttaagatgtttttcagatcctgaattccagcggaacagctgatgccaaccagtttgaagacccccacagaggaaccgaatcagcatgagaacgcagtttcttcatctccctgtcccatgacttcaccctgcactcttcgaccaatcaacgatccccacacctcggcccactccaaaccccttaaaatccctagccccaaactcctcggggaggcggatttgaggtttcctcctgtctcctcattcggctgccctacgattattaaactctttctctgctgcaaccctggtgtctcggtgtattgacttgccgcgcatcgggcaacaaacctattacggtcaca

SEQ ID NO: 405 - DNA, 636 bp, Homo sapiens
  repeat_region (1)..(636): ltr27
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgagagcagcaggaggcagccaatgcctaggtaggcaggggcaggtccctgtgaaacctcacctccaggccgaagacagcttaaatcctgaaagccaagctaccatttaaatccttggaccagactgagaacttgtcttcctgtttggtgtgctttcctctgattgatccctacccttcacctattttatgtatacctaccctttcctaattggttttctgtactgccaggcccacttctgcgtggtgtctttgctttaaccttttttgcatactcacaaaccaatcagcatgcactccccattctgagtccataaaaggccctggacccagccacatgggggactttcctgccttcaggtagggggaccacccctgtgtcccctctgtatttaaagctgtttcatcattcaataaaattcttctctgtcctcctcacacttcaatgttcagtgcatcctcattcttcttggatgtgggacaagaacttgggaatcagtgcacaagccagacttggcctgggaaggccaactgggcagggcacctcctgcggcagatagcatgccctgggcaaggcctctggcatcgccagccagaagtccctgactggcaaagggaccgagaaaaatcctgca

SEQ ID NO: 406 - DNA, 1020 bp, Homo sapiens
  repeat_region (1)..(1020): ltr28
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgatagcgacaggaggcagmcaaatgcctaggcagataggggcgggtccccggtgaaaccccaccttcaagccaaagacagtttaaagcctgaaagccaagctacaagtcccggataaatcctcagaccggaktgagaacttstcttcctgtttggcgcgctttcctctgattgatccccacccttcacctattttacatatacccaccctttcctaattggytttttacactgtcttgcccaccttcgaatgttgyctttkttttaaccttttttgcatactcacaaaccaatcagcacgcactmccccccatcctgtgcctataaaaaccccagactcagtcagtagaggagangacagcttgacttcatasttggnagaagrattgggagagagacaacctgacttcagggaagacgacctgcccttcccgtcccctctccagctcccctctccactgagagccgctttcatcactcaataaaattctccgccttcaccatccttcaattgtcagcgtracctcattcttcttggacgccggacaagagctcgggacccaccgagtgcgggtacccaaaaaggctgtcacactggccctttgccctcgctggcggagggcagccgccccacatgacagaagcagcggcggggctgagccagccchagagccaygggctggagtgaggcaaggggccgactgagctgttaacacgcatccgtctgcagacggcagaactaaaagagctawttagcayactgtaacaccccctctggggcttcggggtcgcgggcayccytacctgggtgctgccgcattcccctccaggtgacatgcctggtctggccgcaggccctgcacagagcttgctcctgtgccggtgcccgaagcagccggccagatcccgcactcgctcgctcgcgtgctccctcccgcaaggggytgagcgbggcgggctgagtagacggggcacccctgccatgagtccggtgaaggggycaagaaaaatcctgcatca

SEQ ID NO: 407 - DNA, 619 bp, Homo sapiens
  repeat_region (1)..(619): ltr29
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tggggctcagaaaccgataccccaaaatatggcgttttgwacatgctgaactgaagaagcctcaaggtttctctgacctccccccanancccccactgtctctcccnaatataagttgaagttcccttatctgcctaaagtccagacccaccaaggagaacaattgttttttgttcccctccctgagtttatctcattngaatctattrcaggaaagaagaccaaagaatgtaaccacacctgaacagaccctttttcaagataatgacttttgtcacaaaycattgtctccaaggatcatttaaattccaaagagaactatttacaagttaatttctgttccyysatccaagatccawtcattctccctagtaatcatttattgcccctcaatagaattcctcttctcccccttcccataacctgttttaccaggatccaagcccccattctttctgtaacctcaagatggtatataagcttctgyacctcattgggaagttgggtcttcattctgaaggctcccatgtatacacgttaaataaatttgtatgccttttctcctaytaattaatctgccttttgtcagttgatttttcagcaaaccttcagagggcca

SEQ ID NO: 408 - DNA, 490 bp, Homo sapiens
  repeat_region (1)..(490): ltr2b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagggaagagagagaccctctcatattgttttatattgttttatactcagtacctgttttaagaaaaaaagaaaaaacaacaaggaagtaaaaccaaagacaggcagcccggcgccaggcccgaaaccaggcctgggcctgcctggcctaaacccagtagttaaaaatcaactcatgacttagaaaccgatgttattcatagattccagacattgtatagaagaacattgtgaaactccctgccctgttctgtttctctctgaccaccggtgcatgcagcccctgtcacgtaccccctgcttgctcaaatcaatcacgaccctttcatgtgaaatctttagtgttgtgagcccttaaaagggacagaaattgtgcactcggggagctcggattttaaggcagtagcttgccgatgctcccagctgaataaagcccttccttctacaactcggtgtctgagaggttttgtctgcggctcgtcctgctaca

SEQ ID NO: 409 - DNA, 429 bp, Homo sapiens
  repeat_region (1)..(429): ltr3
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gttggaggccgaaagaatagggtcgtgaccaactcagtataccactggaggctatatgagcaaacagcaaactgttctcatgaatgcaggatgctggcaagctgacaactgcatctgccaccagaaggaatgctgagggcagtcataccccacgtgcagtgttccttgtggttatctataggaatatctggaggctgttgtataaagaaagcaattatgtgagcccgtgataaatcaagcagctgaccaaccattacctcttcctccctgttgattctacctaataaatacaaagggctgtagaagctcagggcccttgttccctagaagaaaggagccgcctgtctccttctttaaaacagatctttttgtctttgtcttcatttctgcatttgttctcttttgttcagtcccaaaccgacagccata

SEQ ID NO: 410 - DNA, 722 bp, Homo sapiens
  repeat_region (1)..(722): ltr30
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagaggaggtkccagctgggcttcctgggtcgagtaggggctcagaaagctgtgaaactcactcatttcctgcatcaggacttacttcggtcctggatgaataatattgaagatatatgcttaaaatattcctaacaycaggatttgtgcatgtgttttcttccccaagaaagctataaacagcaaaaattttgctgtaagcttccctgtgtccttctctccctctctcccttccccctcccctaaaactaaagtaaaaggaatgttaaaagcccattattttctgtgaccagcagaccttatctatgctcccaattccaattccttgtaaacacactttgtaaartcctgtragatcctgtctcctttgccatgccgctgcaaggtyataaagtagataaaacytaagttrcaattccggttttcctcaagatctaagacatgtcmcaaaataatttactgyctttgtttcttgctctggtaacatcttcccgccgcacgtatttcccgccttaaagagtttaaaaggcgatcaaacaaatctaacactggctacccgctcgggaccccttccacgctgtggaagctttgtactgtcactctgctcaataaagcctacagctttttttctctcttggtccgatccgtgtctctcwctcgccgcgggcwgccgccacaccaaatctttggcgtggctaaggcaagaacctttggcgttaca

SEQ ID NO: 411 - DNA, 619 bp, Homo sapiens
  repeat_region (1)..(619): ltr31
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgcttgcttttggtcacttgctttgtgttatcgttnttattkttttcctttttccatgaagctgaaggccgcagtagctgaaggccttgccgctgaatgctgaaacttaaccttcactggctactttatagataacattcataggtcaccacggtaacggttgcttacagttgtttttcarggaactkgggccagctcctgtccagttcaaaccggttgagaccackaacccttcaactgggcctgcgcaagtgcccaagaggtggccttttgacgtcggagggccaaaaactccaccctcagatcacgctaacgccaccattttctgtacatgtgtcctatgaartgccatgaagcccgactacgcttgcgcagaatgaacctrttacttcatttttccccactgccaatcacctttccccacaccttagaccaccccgcttctctaacccataaatatccctaagccttatcttcggggaggcggatttgagagctgttctcccgcctcctcgcttggcggccttgtgaataaatcttttctcttttgcaaaacccatcgtcacagtgattgrcttactgcgcgcgggcagaacggacctggacctggccagtaaca

SEQ ID NO: 412 - DNA, 471 bp, Homo sapiens
  repeat_region (1)..(471): ltr32
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtcnataaccaagtgtatggtagacgcacctgacagcaataacttaagcataccctgagaatgaccctgtatggcagatgcacctgaatgtgtgtttggagttctgagctaaggaatccgggagtggccaacccggagattcattccttatctatgaggaacatctgagcccccggcccgtcccgtggaacgcaggccatacaggggatcgaggccctttgttttgggttaaatgaaggttgccaggtggaggttgttagggggagggtgctaagtgaaaatgctatataaactgcatgctttttrcaagcggttgcggttctcctgtccagcccaccaccactggactgtcttccctgtatgtaagtccccaataaaccctatgtctcatttgctggctctgggtctcttcttcggcctcttgaacctggtgccatccctattggagtcaataggggtccggcacaaca

SEQ ID NO: 413 - DNA, 521 bp, Homo sapiens
  repeat_region (1)..(521): ltr33
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgctggatatcttctgtttgcccctccagatccactctccacccttctccaccctgctctgtgccccgggaggctgacctctatggactgcatcamcgggctcccttgccctctggcttctggttgggtttggccaatgggaggcactggcaggagattggagggtggaaggagagwgagatcggggtatttattccccyggctccctccctgctgggctgcggtttggcagtggctgcgttcctctaccgaaggccacagctcctgtcgggcagccctctccttgtagctacagctmcagctctctctgggttccggtaacmgctccctccccttgccccttcaggcctaggggtggtaacagctycccgctgttgctagccccggggtgcttcaccatcccttgttggtttcccttaaccctgcccacacctttgtaaatagtcccttcattaaactctcctcaattactccatttgagtgtgccatctgtttcctgccgggaccctgactgataca

SEQ ID NO: 414 - DNA, 523 bp, Homo sapiens
  repeat_region (1)..(523): ltr33a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgcctatttgctctcagatccatccctgcccttytcctgctctgctctntatcacaggaactgcatttcccaggctcctttgccacctggcttctaggtaggtttggccaatnggaggcactggcngnaggagattagagggcaggaggaagggagaagccagggtatttctccccctccctctctgccttgggcagtantctctctagcagcagttgcatgcatctcctctgtggttccagctcctaccagacagccccnccctctgtggttccagcttctaccaggtggccctggctcctgggctctggtaattccacctcctccctccctttgtccctccagccctaggggtggtagtagcttcttgctgttgctaatctctgggttgcctcaccattgnttccctgtttggcttctcagctctttcatcacctgtgtaaccaattccctgtattaaattccctctgtttgaaatacctagagtggtttctgttttcctgattggaccctgactgataca

SEQ ID NO: 415 - DNA, 699 bp, Homo sapiens
  repeat_region (1)..(699): ltr34
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtaaagaaaaataaaaaatctcaggacccccnnncyccntaaactccttatgcccggaggccgagtcattgcaacaccctcttccaaatgaatagctgttactagcatcatgcatcagccagatccccaaggaaaggtaaaaggcctcaggcatctgcaaaagactgcccccacagatcattcataagtaaattctttgctggcctcccataaacaaggacatgccaattgtaactttaggtctgcaacctaagtctagctcctaaaactaaagtctgttcgattccacactgataatgtcaattacaagcttatcttcccaggtgcagaacaaagacaaggtgagatcagtcatttcctccacctacccagagacgtctgcataattgactcttcctttactccctttttctcttcaaacattcaccttatcttatgtaaaatatagatttactgggcactaactaaagtctcacaggaatgtaarccatttgccttaccgcctacctgcccctcttcctacatgccttcccycactttaaggaaatgtataaatactaaacctcctgaaaacctcttcagaaaaagcagccacagatgtgtctgtggctcgcgtttttcccggacatgccctaaagctggcttaataaacctcgattgattgagacwtwtgcctcagtcactcattttggttgtca

SEQ ID NO: 416 - DNA, 599 bp, Homo sapiens
  repeat_region (1)..(599): ltr34b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgtgggagaccagaatatgccaccccaaaatatgcctctttggcataaggaytgttgagctgaaggcaattaagaagaagcagatgcaggaaagctctctgccctccctctatttgcctaaaagcaggacatagatttacaaagacaaaaggtatcctgcccccaccccttctaccagggagaacaaaggttaaccactgaagacaactttagacccttattggcctggagatggtaccagaggaatctacattaacaagccttactaactagcctttatctgccagttatttgccttcccacaagttgctgcccctagagactcaaagtccttttcctttgtcttgtcacttctctaaaaatttnttttactgttctttgttgaagatgctatataagctggaattcaaagccacctctttgagaactactcattctctgggtgtctcccatgtatatatgaaatatacatgttnaaaaataaanttaataaacttctgtctgtttttctcttgttaatctgtcttttgttacaggggtctattccaactaagaacttatgagggttgaggagaaaaaattatttttcttcccctaca

SEQ ID NO: 417 - DNA, 616 bp, Homo sapiens
  repeat_region (1)..(616): ltr35
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tgagacagagtagggatggggcttggyttcagctcacccccactrgagcattctttcatgcattcccactgatcacaaaacccacaccactacctcactganactatayccgctawymkksrkrywywrrwmatasmmakwmwatawwswtyytttkkksmyyycwnanntttaaccatgccttttacttaaagaattccaggaactggccttaggagatcyaaacatcgaaccaaggttgcagagtgtcccacctcgggaaggaatgctgaacaattgatttacagccttgttgccgctggccagaccaccaggtggcccattactcaagataaccatcgcaaccagataatgctgacctgcataccctaccytcacgtgctttgcccagcccagcctgcataccctacccctgatgtcaattcccgcgctttgcctaataaaaaaatccctaccggctcttttcggggaatcagctcarggaattctckctctctcttctgctgtctcccttgtgcycragcataagctccaatraagccttgtctgggaaaactgcttggycccgtgttaatttcyattacatggrgagcccaggaacctgtggtcnntaaca

SEQ ID NO: 418 - DNA, 1450 bp, Homo sapiens
  repeat_region (1)..(1450): charlie1a
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagcggttctcaaagtgtggtccgcggacccctgagggtccccgagaccctttcagggggtccgcgaggtcaaaactattttcataataatactaagacgttatttgcctttttcactgtgttgacatttgcactgatggtgcaaaagcaatggtgggtaaaactgctggcgccttagcacggatcaaggcagtggcaccaaactgtactagtagtcattgtattcttcaccgccacgcgctcgcagtnaaaaaaatgccagtttcacttaagaatgtccttgatgaagcagtaaaaatkattaattttattaaatctcgacccttgagyacacgtctttttaatattctgtgtgacaaaatgggaagtacgcataaagcacttctgctgcataccgaagtacgatggytgtctcgaggaaaagcacttgtgcgattgtttgagttgcgagctgaactagctacttttttcatggaacaccatttttacttgaaagaacgactgacagacaaactrtggttattcagacttgggtatttggcagacattttctcaaaaatgaacgaagtgagcctgtcacttcaaggaaaacaactgacggtatttgttgccaatgataaaattcgagctttcaagcgaaaattagaattttggaaaacttgtatctgccaccgtgagcttgacagcttcccaatacttaaagacttttctgatgagatcggtggtgatattaacgaatgtgattttttgatattgtataatgaaatgtgtcaacatttggaagatctgcataactcagtgaaccartattttccaaatgaccaatgcatgatgttacaaaatcatgcatgggtaaaagatccattcaaagcgcaagatagaccaatggattttaatgtaacagagtacgaaaagttcattgatacggtttcagattccacaccgcaactaacctttaagaaactaccacttgttgagttttggtgtagtatcaaagaagaatatccacaattatctgaaaaggctattaaaatactcctctcttttccaactacatatctgtgtgaggccagattttcttcatatacttcaaccaaaacaacatatcgcaacagattgaatgcagaagcagatatgagaatccagctgtcttctattaagccagacattaaagagatttgcaaaaatgtaaaacaatgccactcttctcactaaatttttttgttttggaaaatacggttatttttcataaaaatgttatttatgttaacatgtaatgggtttattattttwaaatgaatwaataaatattttaaaaatttctcagttttaatttctaatacggtaaatatcaatagatataacccacataaacaaaagctctttggggtcctcaataatttttaagagtataaaggggtcctgagaccaaaaagtttgagaaccgctg

SEQ ID NO: 419 - DNA, 518 bp, Homo sapiens
  repeat_region (1)..(518): charlie1b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagcggttctcaaagtgtggtccgcggacccctgagggtccccgagaccctttcagggggtccgcgaggtcaaaactattttcataataatactaagacgttatttgcctttttcactctcattctctcacgagtgtacagtggagttttccagaggctacatgacgtgtgatgtcgcaacagattgaatgcagaagcagatatgagaatccagctgtcttctattaagccagacattaaagagatttgcaaaaatgtaaaacaatgccactcttctcactaaatttttttgttttggaaaatatagttatttttcataaaaatgttatttatgttaacatgtaatgggtttattattttwaaatgaatwaataaatattttaaaaatttctcagttttaatttctaatacggtaaatatcgatagatataacccacataaacaaaagctctttggggtcctcaataatttttaagagtataaaggggtcctgagaccaaaaagtttgagaaccgctg

SEQ ID NO: 420 - DNA, 224 bp, Homo sapiens
  repeat_region (1)..(224): cheshire_a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggggtcggcaaactatggcccatgggccaaatctggcccaccgcctgtttttgtaaataaagttttattggaacacagccacgcccattcgtttatatattgtctatggctgcttttgcgctacaacggcagagttgagtagttgcgacagagaccgtatggcccgcaaagcctaaaatatttactatctggccctttacagaaaaagtttgccgacccctg

SEQ ID NO: 421 - DNA, 338 bp, Homo sapiens
  repeat_region (1)..(338): cheshire_b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
caggggtcggcaaactatggcccatgggccaaatctggcccaccgcctgtttttgtactgcccgtaaactaagaatggtttttacatttttaaatggttggaagaaaaatcaaaagaagartattttgtgacatgtgaaaattatatgaaattcaaatttcagtgtccataaataaagttttattggaacacagccacgcccattcgtttatatattgtctatggctgcttttgcgctacaacggcagagttgagtagttgcgacagagaccgtatggcccgcaaagcctaaaatatttactatctggccctttacagaaaaagtttgccgacccctg

SEQ ID NO: 422 - DNA, 6896 bp, Homo sapiens
  repat_region (1)..(6896): harlequin
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tttcttggttccctgaccaggaagcgaggtgattaacggacggtcgaggcagccccttaggcggcttaggcctgccctgtggagcatccctgcrggggactccagccagcytgagtgacgcggatcctgagagcgctcccaggtaggcaattgccccggtggaacgcctcgccagagcagcgcgtggcaggcccccgtggaggatyaacrcagtggctgaacaccgggaaggaactggcacttggagtccrgacatctgaaacttggtaagactagtctttggaacttgccccactccatttgagtggaagcgtggcctgatcacccayggtgtgcctgtactggcactttggtttttgtttttgacttgacttggattgcttgatactttggttttggttttgacctggcttggatttctggatactctgattttggttttgattttggtttggtgtaaactgtaaaagtgtgtgtgtgccctttttacccgttctttgttttgtggtgtgcatgtggtgtgagcgtggtgttttgtctcgaagaagcatgggtcaggcacaaagtaagcccaccccactaggaactatgttgaaaaatttcaagaaaggatttaagggagactatggagttactatgacaccaggaaaacttagaactttgtgtgaratagactggccagcattagaggtgggttggccatcagaaggaagcctggacaggtcccttgtttcaaaggtatggcacaaggtaacctgtaagccagggcacccagaccagtttccgtacatagacacttggttacagctggttttagaccccccacccccacagtagttgagagaacagcagcataagcggctggcagaggcaaggaaagaccagcagagagavagagagaggaaagagacagagaggaaaagaggcaaagagagagaggaaaagacagagaggaagagacaragagacaaagagrgagtcaagaagagagaaagagggaggcagagagagaggaagagacagaggcaaaaggaaagtcagagagagacagaaagtcaaagagagaaagaaagagagaaatatacaagtagttaagaaaaaaaacagtgtaccctattcctttaaaagccaaggtaaatttaaaacctataattgataattaaaggtattctccgtaaccctgtaacactccaataccactttgttgtcagtgtaaacaagggcgtatcccraaagcactgaggccttcctatcaaaaatccttaacccagtaacccgcggatggcccaaatgcattcaatctgtagcggcaactgctttgctaacagaaaaaagtaaaaaaaataacttttagaggaaacctcattgtgagcacacctcaccagttcagaagtatcctaaagaaaagaaaaaagaaaaggatgatttaacattaaccactgaaaattctcttaacccagcagktttcctaacaggggatctaaatcttaattaccatacaaaggtccgaccagacctaggaggaactcccttcaggacaggabgatagatggttcctcccaggtaattaaagrrrgaaaaaaagccatctataccaattctaagttaatttggactaaacaaggtcttattaatagcaaaggataattgaaatcccaaacttacaaggttttcaacaaaagtaaagtttgctaaaagttaacagtgtaacatgtattatagtaacttctaatcttgtggccttagacagtctagtccacagacataaaggaagttcgctttggaaaagaatrgttatcatcttcgaaaaaaaaagagaggraagagggggcagaatttatgtaaaaagagtgttatatggtaaattcttgtcctgaaataaattaactggttgtttaaagaaagaaatgtttgtaataagtcagaaagttgagrcatgtcgaagaattgtctgcgaaagtcgtgaaagaaaaaaatgttataaaaaaagaatttatgcaaraaatgttgtataatttaaaagtaatwaggcctcctgaatgtaaaactattgaaaaaacagtttatgtgcaaggtgtataagaaaagtaaaatatacctttggtaaaaggattataaggaggcataagaatgtggatttttacctacattaaaaggttaaaaaaattattgttttgaaggtttaagcaagttttaaaatgttaattgtaaagaaaattctgtgtgtaaacatattagctaaagttaaagaggtatcatccagtttttctgtgaactggacattaaagtaaaaacgcaacgggtttttcttaaagcaccaacctgctctttaacaaaaattataaaaggttaaaaagagtctataaaaatcttaccttatggtcaaacattaaaaattgrataaatatgtctacaaagttttattaaaaytaagtttaacattaataacacactaatataaaggtaaaatttagcttatctggtataaaaatcatacaagaagcattgtyaaatataaaatggtgtttggctttctttggtctaaaaactaataaaaataggtgctaaaggaaatttctcagtaaaaaggcaccaaggactataaagtccactgctgatgttcccacatttaaaacaaaaggtcaatttcttaaaaattatatacttggtttatcttccactttcctttccctcaaaactaaaagtcttttagcacatgtaccacccctagaatttccagtaaaccagcaccagcctgaagatcacgttctcatcaaagggtggaaagaaggaaaacttgagccagcctaggaaggaccctaccttgtgctgctaaccaccgagactgctgttcgtacagcgaaaaaaggatggactcatcacacccgagtcaagaaagcgccaccccctccagagtcgtgggccatagtcccaggggaaaaccctaccaaactaaagctaagaaaaatttaactctttcatctattctattactctttcttctttcctcgctctattgctgaccatctagttattaacataaccaagtcaatttcgcctcaaactattgcatttaatgcttgccttgttataccctgtggggacttgccaagtcaaagacagctctctacttcagaaaagtacctctgtccctcctgactctcctcagactgggcattagtaaattaggaccatttaatccggggagatttcgataaagaccccagtgtcaaccaggagtcttgccccccaatgtagagcttttatgccatagttggtccaacgttctgtggaccactaaagagcaaggatggactgccccaaccggtttttgtaatttcctaaaatcatacattcattttactagaggatcatagaagttaaagacttaaaacaaactttggcaattaagacaggataccaagatgcaaatgcctggttggaatggatcaaatattccatccgcacgttaaacaaaagcaattgttatgcttgtgcacatggcaggccagaggcccagattgtcccctttccactaaggtggtcctccagtcgaccaggcgtgggctgcatggtagctcttttccaggattctacagcctggagtaataagtcatgccaagctctctctgctatatcccgaagtccagcaccctgtgggtcagcccccgagggccatccagcttccgtctcccaacactaagttcacttcgtgtctctcacgacagggaggaaacttagcattccttggagacctgaagggatgcagtgagcttaagaattttcaagagcttatcaatcagtcagcccttgttcatccccgagcggatgtgtggtggtattgtggtggacctttactgggcactctgccgaataactggagtggcacttgtactttagtccaattggctatccctttcaccctggcatttcatcaaccagagggaggaaaaataagacatcgtaaagcgagagaagccccttatrggtctttcaactctcacgtctatttagacgcaattggagtcccacgaggaataccagatcaatttaaagcttgaaatcaaatagctgcaggatttgagtcaatattttggtgggtgacagttaataaaaatgtagattagataaactacatctattacaaccaacagcaacgagcttttcatgagttaaaagaaaaactcatgtcggccccagccctggggctacctgacctgacaaaaccctttacacyctatgtgtcagaaagagaaaaaatggcagttggagttttaacccagactgtgrggccctggccaaggccagtggcctatctctcaaaacaactagacggggtttccaaaggctggcccccatgtctaagggccctggcagcaacggccctgttagcacaagaagcagataarctaactcttgggcaaaacctaaacataaaggccccccatgctgtggtgactttaatraataccaaaggacatcattggytaacaaatgctagattaaccaagtaccaaagcttgctctgtgaaaatccccgcataaccattgaagtttgcaacaccctaaaccccgccaccttgctcctggtatcagagagcccagttgaacataactgtgtagaggtgttggactcagtttattctagtaggcccaacctccgagaccatccttgaacatcagtagactgkgagctgtacgtggacgggagcagcttcgccaacccctgcaaagtgactctgaagaagacgacaagccctgctccagtcacacccggaagctgactggtccacgcacggccgaagcatgagaaaactcatcacgggactcattttccttaaaatttggacttgtacagtaaggacttcaactgaccttcctcagactgaggactgttcccagtgtatacatcaagtcactgaggtaggacaaaargttgctacagtcctattattttatggttattataagtgtactggaactctaaaaraaacttgtttgtataatgytattctatacaaggtatgtagcccaggaaatgaccaacctgatgtgtgttatgacccatctgagcctcccatgaycacagtttttaaaataagattaaggactgaggactgctgggggttcataaatgatacaagtaaagtgttagccaaaacagaagaaaaaggggtgcccaaacaagtcaccttaaaatttgatgcctgtgctgttattaatagtaatmagtataggaataggatgtggttctcttaattgraaaaaagaggctatacggcagaaaataagtacatctgtcatgaattaggactgtgtggaaataartgtaaatactggtcttgtgtcatttaggctacttagataaaaaatgaaaagaatcctgtccaccttcagaaaggraaaagtggcccttcctgtaccagtggwcagtgtaaccccttagaactagtaataaccaacccccttgatcctcactggaaaaaaggggaacgtgtaaccytaggaatcgatgggrctggactggatcctcgagtaaatatcwtagtttgaggagaagtttataaacgctctcctgagccagtatttcaaacyttctatgatgaactgaatgtgccagtaccagaaattccaggaaaaacaagaaatttgtttttgcaattagccgagcatgtagcccagtctctcaatgtcacttcatgttatgtatgtggaggaactgtaatrggagatcaatggccatgggaagcccgagaattagtacctacagacccagttcctgatgaattcccggctcaaaagaatcaccctgataatttctrggtcctaaaagcctcaatyattagacaataytgyatagcaagagwrggraaggahttcacycwtcctgtrggaagactyagttgccttgggcaaaaactgtataatagtaccacaaaaacagtcacctggtggagttcaaaccacacwraaaaaaatccatttagtaaattcccaaagttgcaaaccgtgtggacccacccagagtcccaccgggactggacagcccccactagattatactggatatgtgggcatagagcttatgccaaattacctgaccagtgggcaggtagttgtgttattggcactattaaaccatctttcttcctactgcccataaaaacaggcgaactcctgggcttccctgtctatgcttcccgcgaaaagagaagcatagctatagrwaattggaaagatgatraatggccccctgagaaaatcatacaataytatrggcctgctacttrggcacaagatggctcgtggggataycggacccccatttacatgctcaaccgaatcatacggttacaagctgtcttagaaataatcactaataaaaccagcaragccttgactattctggcccggcaagaaactcagatgagaaatgctatctatcaaaatagattggctctcgactacttgctagcagctgaaggaggggtctgtagaaaatttaaccttactaattgctgtctacacatagatgatcaagggcaagtagttgaagacatagttagaaatatgacaaaactggcacatgtgcccgtgcaagtgtggcatggatttgatcctggggccatgtttggaaaatggttcccagcgctaggaggatttaaaactcttataataggagttataatagtaatagaaacctgcttactgctcccttgtttgctacctgtacttcttcaaatgataaaaagcttcatcgctaccttagttcaccaaaatgcttcagcacaagtgtactatatgaatcactatcaatctgtcttrcaagaagacataggtagtaaraatgaaagtgagaactcccactaatgagtgagattctcaaagggggggaa

SEQ ID NO: 423 - DNA, 7418 bp, Homo sapiens
  repeat_region (1)..(7418): huers-p3b
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
ttttggkgcatgggcgggaaaacsaaggtacaacmttcattggagtggtgagtatggagtggacctcaaaatctgtcctttcatttcgaggctctcagcctccattttaaaactaaatcaaacgggcgtccttcagccttataaatatgattagcattggctnccgttctaaagactcggatgtcaggcttgctggggagaacatggagaatcccccantactcacgggttattgggnatnttggccatgtttgaacnagcttcgtttcatagagaacctagccatcatgtgaggctggnagaagtcctggggcaactgagaatttccggccggggcacaccctggcgtkattcaagggcctctggaccgacgcagcctccgacagccgggtgttagcaaaggatccncagctatcctgtcgccaaattttcctcctttctctatccatggtctcttacctctctctgtgtgttcaatgtgcaggaatctttacagttcagggaaaacagkcctgttwgamaagatcagtgaatcacggcagccagggatataactcaaagggaaggcatctttgtgattttctaggaacagaaccccccaacccttccacagtaagcgtttctcttggcccttggtctggagagcacatggcatttccatgtcactctctgcccttggtctggagagcacatggcagttccaggtctctctccccttggtctggagagtacatggcagttccaggtctctctctgcccttggtctggcgagcacgtggtatttctaagccacctagtaggaataaggatcctctccatgaggcacattgccggtcctctacggaacactncagcttccaattttccctttttgcgctcttttactgctacttctgtgaacgggaagactctgctttcaacaattaggagtaaaatgtcctccgaagccgaattttagtctcgatactgtcccatcagcaggaaaacggccattcggtccctacgttcttttaaggcacctattctgtctccaattaggatggtacttaattagtaaggggawttttaagtccggaagttaaccggaaccattcttctatgggtaaatgctttagcataggccataatagcaggatacagagttcaatctagcacgccccctcccttaaaggggncttgcccaattacatggtttttcttgaaatccgtnttttggaaggcacacaggccacacaagtctagaaggtcaaagggaaataaaaggcagaggactagactgcttggggamagcgtgactaaggaactnagttcctctggtgccacggcttggagggtcacacctgcagtcacgggtggcacatttaannaggtgccgggaatccggaancaacagagagaaaatagttggggggacgccccctactgttttcgtctccaccctggatcacataccgaaaggaaggagactaaaagnacgcttttattctcacttctctttctagatgggtancagatcgtcttcaacgtgcactcccctggagtntattttgaagcactgggactccttcgaccctgaaactttgaagaaaaagtggcttattttcttttgcacaagggcatggcctttttactagacctttgcaacattgcaaaatcaacccagctcttttagcaatcatatcaggcaggcccanggagaatgattccccaaaattagagaagcaactttcaggggaancatctgaggattcctcttatttggggccccttcaagttcccttctcattacaggaccttaggcaagtaaagggagacttaggccaattttctaacgaccctgataggtatacagaagctttccaaaatttaactcaggtatttgacctctcatggagggatgttatgctgctgctaagccaaaccctaactgcggctgaaaaacaggcagctctgcaggcagmagaaaattttggagatgagcaatatgtctcctatagtaggcmaaaagggaaaagagaaaatagggaaggcgaagaaataggggaaacamcattgccaataggaagggaggcaatacttcttgacaaccctaattggaactccagamttttctatggtgtttttccttctttcacggtttaaaatggcttctatcttcttttataatgttcttccaacctgggaaaagttaattttccaaaccttaaaatgcttggcttagagttgagctagggggaagggaacccagaagcctgacatgctggcaaaagggtaaacatttcttaccagtcgggcttttggcttctctctccctgtgcaaaccggtaaaagggataataaggatcattgtttatattctctgtaaakttttaattaatgaaaaaggatttgtgaggttggtcttaagctgtagmcaatctggtgtgctttgcgtgtctttctgtatggttctgtcaaaagaaagggtaccttaggttaggatgcaggcccaggaccccataagcctgctgttcaagccagcccaacaaaatggtcagtaacaaacttggctacaggcctccatcttgtttcatgtccttgggaacatgacctgtaaccacatggcaatactttgttttagtctccgccattttacaatggtggctgtcttcttgtgctaagtcagttcctgggtgagggccacaaaatcagataagccagtttgtcaatctgggtggtgccagctgatccatcaagggcagggtttacaaaatatcttaagcactgatcttgagagcagtttagggagggtcaaaatcttgtagcctccagctgtatgactcctgagccatggtttctaatcttgtggctagtttcttggtctggtccccaggcaagagggaagtatatcttgggaaggggctgttatcatctttgttttggactatagactgtaaaccaggcccctcccaaagttggttcagcctacacccagggatgggcaaggacagcttgggggctggaaacaaaatggagttgtttgggtsggatctctttcactgtctcagtcacagttttgcaatgacagtttcaaaagctgcctatcacccctttaaaaataccttgtacactcgtggttaagtcataacctaattaaggctcgttggtttcacctgtgaggttactttttgtaaagttcaaaagccgaaaatcttaactgcttggcatggctaaagtcgagtaacaagggatttaaaaggattttcttaaagagcgctcagcttaattaaaagtggatattcaagttataggtatatttaaaaggcctttatgtttttctcttcttgaatcttgcttttctggaaaagggsttttcttctcagtcgactgaattattttctccnttttttgtcttgccactcttaatgcatgcatgagaggccctaagataacttctggtagcatgggactccttgggaaaaacagaggaggcgccacagaccccgttttgggaaaaaacccctgttttcctcatgaaaccccaggaattaaaagcagatagttccctctcaaaatcaaaggctctgttctgttttgcattgtgttatctgacagttttgagttttgggggcatcagaattacttcacattatgagagagctttggtgtgtaataactaggtaggaaatacactktaagggatgsctaatagtagttataaatcagagaagcatgctcttggccacctgaaagatatggaaacatccccaccccccactgagagatgagactmccatgggggatgggctgattacaaaataagccaattggctttgggttgccttgcaatgaaatgcatggtagaagcactacactgtcttctcccatagtatctccctccttttggggatctaaaatctagtataaaaaggcacacttaattttgggatctgcctttgccttcagctgtgcttgcttattttgccctagaaatgcatgccttcctggcactgttcctccaagggctccaccctgaagcaagtaatccaattaagaaattggcaaatacaaaaatcgtacaagtgttgaatcttctgtttgtggtcgctataaatgtgttgtgtgtaatgtctataaaaagagctctaattgattggcttaaagaaaaataggcacttaagtcaaatattttttagttcatatgactttaatctttaagaaacaaaaatagtcttaagggttattggtaaaatgcaagtgtcatcaaaattcaaataggtggtctaaatcatacaacttagatactaggtttgctaaatgttccaaggttgtattactggttgctttacagataggtaaggccttggacacgtagagttagatactagaaagagtcaaaccttatctgtacttctatctgggtcctaggttccacacctggtaaataattacaatcacttactaaccaggtttttcaccaatgtaaaaattgctaagagttaacagcgcaacatgtatttgagatgactaaacagttttatctgcaaagtgtataaaaacagtaaagtatgtcttttagtaaaagattacaagaaagcatagaaatgtaaattttgcctagggataagggattatcttaaatttgatatgataaaggtaaaggtttaagtaagttgtggaagattgtaaaaattaatcttgcaaaaaatgtgtaaacattaactaaattcaaaatagtatatatggtcttttcacaaattgagcattgaaataaaagcacagcaaggakgtcttaagacactaatctgccctttagcaaaagggttataaaaggtttgtaaagatttcacctcatggtcaaattggttaagattagatggaatnatctataaggtttcatnaaaacgaactggggttaacattaataaactaatgcaagggaaaaatttggctttgaacaggattttcatgtaatagtaaaggctaatgaaaggtttttgccttttgagtcatcattttggcaaaataagtaatttatggcaatctggaattctattttgtaacatcaagtgttttaannctctaacacttaacagncnccccaaaatcnaacttcaagtttcaaaattgtctttcctgatgcctggctttctggatggttcagagggcccctgaaacattcagaaaagaggtaaacaggatcgtttgacatgtttagtcacatgagattgccaaaatgatgtccaatcttctttaagttatattttggtgaataatactaatatatgttccaaaattgtatgggatttctaaaattctaatgtctaagtatatgctatcaatcataattaagggtaaagttattgtaaaccacggagataactaaacttctttntcagtcatgtttttaactgtaactaccctggaaattttgtcattcgcagacaattgttgtcttgctttgttccttctcaaaagatggtttataatcaagctatattaaggactttaacaggtgttctcaaatgcaggtttttaatagctttgaagattgtaacattggaatagagaaagaacgtacaggactcatgaagaactgamatgttcacaaatatcaagcaaaacaagagttaactaagtggactgcactcagaaagttaaagcaacctttttgacttttgcttggaatattgctaatccttgttttgtttttcagagtcaaggaaacttattttgaactatttacggcctttaataattgagtaaggtatactcctgtgaacaaaatttggagcatgtttgtttttctctgcctggttcctctagaatktggaaactatctgtgagtactcttaacttatggcaatatagttgtttgcatcagtgcaatacgaatccatttttctttkkcaacaggacacaattggaaaaactggttattttaccaaggctttgactggaagggtgtgcttccctttaaggagtcaakcttgacatgcagagccaataaaagccccttggggagaactggcctcataccttgtctacacagtccccacacagggttcctgacctgtggtcagtaaagaatgtcactttctaacaggtccaggagctccaagtttatcttgggaccttaagaggagaggatcacccaactcacaggtatttgaggatacgaacccatggctgggctcggctttaaggggtcttatctgagattccttgtggaacagagttccatcaaagccaatccaaaaggcctatgtagaaataaccattcttgctgcactttatgcaaataatcaggccaagtataagactaaagtttattctacaaacaacacagtcctatcataatttgtttttaccaaaaatgagaactggagagaaaaattatgccccaaagcttatcatacatttgtcattaaatcctagtctcattaattgtttttaagctttttgcctacgttttagactaaccctgcttattcctgtgaatcamgtggtgatcttctgcagcttggaakaaaagaawagggatgggkaakgtaaaaatstgaatcaatatgctggttctgggcaattatcctgcaaattctgccaggtaatwaaagtgagtgagtagggtgcccatagcctggaggtttctttgtttgggaaaataaaacmagggaacttcatagacccccaaaggggaattctaatatcttggcaagtaaaattttaggtggaaattacctgccacaccacacttgtgggaactgctgtmctcaccccactatttkcaatagsgttacacacggtascaccttmwagctgaaatattggacagagagtttccattgccgtagtattctgcttaattattatccttatagcagggatagtagttactgacgaaaaggaagcatgaaagttttactatcaccgagtctgccaggactttttactgggtttagtgatgcasttttaaatgaaacatgctgcttctggattaamamctctastaaagtagaggaaaatctacgsgtacttagagatsaaatcaaaatcattgacaggctcagggaaaatgccggcttcagccccgggtggctacaatccctctttaatgaattccwgtcttctttatggaattggttaacccctttattaagcmctstcttgcttatmtgtcttgtattgatatttggaccctgtatactcaatactgtaactcaaattgtttcctctcgcctagaagcaatcaaactccaaatggtgctgcaaaccgaaccacacgccwttcttccaaggacccttagatcgacccaggaggagccctagctgctgttmcccacwcgatgscccctttcagcaggaagtagccagaaagagtcatcgcccaawccccccaacagcagttagkgtkgmmwctccasagsggggagtgwtgc

SEQ ID NO: 424 - DNA, 7417 bp, Homo sapiens
  repeat_region (1)..(7417): hervk14ci
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
tctggcacccaacgtggggctccccataatctctacaaataatccagtgaagaaacgccagagcgtggaaagtggaggacgactgacaaaggttgcccgagtacgttttcacttcaggctctacgggtaagtagggtgctcggagaattccagggtaacctcgggaaaatacgggtcaggctgaaagtaaatttgcaaattacttaagcctggtgcggcagttattgtgccacagcggggcaattgtgagtacccaaaatctcacatctttgttccatctcatagaaaagtattctcctttgttcccgggatatggaaccatgaatgtaaaagattgggacaaggtcggatcagacttacaaggagcacaacaagagggttacgatatttccttctccgcttggtctgtgtggtcagcaatcaaaacagcactggagcctttctacactgaggaggatgaggagtttcaggatgacatacaaaagtttaataatcaggagtctgatgatcagcaaagtgaaccatcacagtctagtttaaaaaagggggagaaacaggaagctacatgggctaacctccaaaaacttatgaaagaaacagttccacctactgaagaaacagtgccacctactgcgcctttaggggaaggtccggaacggccacccctgcctcagccttatgaatttttgtaacgagagcctgagacgcagcttgccactcccattgttgcacgccccaccattaactatggcaaagggaagcttcagtcttgcccaacagccaattacagtgagggaatgatccaggttggtccacctgttaattatggtagaggaatgctgtgaaccggcccaaatacatattatggcgcagggataatccaggcatccatttgccaggcatgagaaatgggggatttggatgcttggcagtttctggtaattatttcgccagctgaggagcctggagaacatgctcaagcgtgctgggagccatttccttttaaaatattaaaagacttaaagcaagcagttggacaatatgggccaaattctccttatgttcattccttgttacaatctgtggcgtataaccagcatttaatacctatggattgggagacattagcctgatccaccctgccccctctcaatttctccaatttaaaacctggtggatggatgaagcaataaatcaggcatgcagaaatgctcaagcccaaactttcattaatatcacatctgatcaattgcttggaagtggacaggcatggggtactctaaatcaacagatggtaatgggtgatgaggctgttgatcagctcagaactatatgcctaagagcctgggaaaaaattcactaccctggtactacttatccttcttttaactcagtttgacagggtcgaagggagccttatccagattttatcgttcgtttgcaagatgcggctcaaaaggctatttcggattttcatgccaggaaagtgatcgtccagctacttgcttatgaaaatgctaatacagaatgtcaggcagcaattagacctattaaaggaaaggcagatctaaatgaggaaaaaactttaagagtatacattaaagcctgtgatggcattggcaggcacttatataaggccagcctccttgctcaaggaatggctggactaagggtaacaaaaaacatatgagtgtgccctggatcttgctataattgtggacagataggacatacaaaaagagagtgtacaaagagccaaaaaaggcaaaactcaggaggaaaaagcagggaaccaagtacctttcctagaagtaaaaaaggaaaagactgtgctaatcaatgtcattcaaagtttgatgacagcagacagacagaacttgccaggaaacggacagaagggccagccctgggccccgattcaaaatggggcattcccaattcaggatgggatgtccccaactccaaacggagtgtcctcagcccagtctatccctgtacgaatgtacaggaattgtccccctccacagctaaaagcgggccagtagatttatgctgtaccgaagccgtatccctccttcctggggagcctcctaggaaggtctcagtggaagtttatggcccattgcgaaatggcacggtgggacttatactgggaaggtccagcttaaacttaaaaggaattcaagtacatactggagtagtggactctgattgccagggagaaattcaaattgttatctcctccactgttccctggagtgctaatcaaggtgacagaatagctcaaatgttgcttttaccatatgttaagttaggagaaagctcagaaaaaagaacaggaggatttggaacacaaattcagcaggcaatgctacctattgggtacatcaagtctctgacaatagacctatttgtatggttactattcaaggaaaacaatttgagggtctggtggacacagaagcagacgtgtcgatcatagctctttatcaatggccaaaaaactggcccaaacaaaaggccccagtaggtcttgttggggtcagaattgcttcagaagttttccaaagtacttttatcttaccatgtcttggtccagaagaacaggaaggcacactacaacctctaattatgcccattcttgataacttatgggggagagatctgcttcagcaatggggcacagaaatttcaatcccttctccccagtttggtcaagctagtcaaaaaataatgtcaaacatgggctatgttcccagaaaaggcctaggaagacagggggctggcattattgaacccatacaagttactgtaaaaaatgactgaaaaggattaggttaccatttttagggctggtcactgttgagtctccaagttctattcccttaaaatggaagacccaaaatcctgtttgggttgagcaggggccactttctcaggaaaaattgggggccttacaggaattagtcaaagagcaattaaacaaaggaaacattgagcccacatttcctccatggaattcgctcgtgtttgtaataaagaaaaaatccggcagatggcgcatgctaaccgacttacgagcggtcaatgcagtcatccagccgatgggggccctgcagccagggcttccatcccccaccatgattcctagagactggccattaataattatagatttgaaggattgcttttttaatattcctctagcagagtccgattttgagaaatttgcttttactattcctgctatgaacaacaaggaaccagcagccagatatcattggaaagtcttgccgcagggtatgttgaatagtcctactgtttgtcaaacttttgtggggaaggctattcaacctgtgagagatcagtttccagattcgtatatcattcattatatggatgacatattgtgtgcggccgaaaatcgagaccaacttattcagtgttactcatatttacaggaggtggtagccaatgctggattgctcatagcaccagataaaattcaaaccgccactcctttccaatatttggaaatgcaggttcaggaaagggcaattaaaccacaaaaggttcaaattcgaaaagactctctgaaaactaaatgattttcaaaaattattaggggatatcagttgaatttgacctactttgggaatccctaccatgttatgtctaatctgttctctattttaagaggagaccctgctctcaatagtaaatgataactgactcctgaggctgacaaagaattacaaataattgaagaaaaaatacaacaggcccaggttaatagaatagagtcaagtttaccattacagttcattgtgttccctactctccattctcctacaggggttatagctcagagtgaggacttagttgaatggtcttttctgcctcacaatactgttagaacactcacagtatacttggatcagatggcaatcttgattgagcaagcttgccttagagttgttaaactttgtggctcagatccagataagattataattccaatgaataaaatcagatttggcaagcctttgttaattcggtcaattggcaaataaatttagctggcttcattggagttcttgacaatcattatccaaaaaacaaaatttttcagtttttaaagctaacatgggtccttccaaaaattacccgtagtgctccattggaaggagcagtgactgtgtttacagatggctctagtaatggaaaagcagcttacgtacgacctaaaaacacaattattcaaactgactttcaatcggcacagaaggctgaattacaggcagttataggtgtgttcgaaaactttaagcaaactgtaaatattgtctttgattcagcttatgttgttcaagccactcaacacatagaaactgcactcattaaatatctggtggatgaacaactctatcagctgttttcttctttacaaaaggcagtgcatgatcaccgttttcctttctatattacacacatttgagcacacactaatcttcctgggccccttgtaagggctaatgatcaagctgatttattaatttccactgtgcttactaatgtccaagattttcactccctaacacgttaatgcagcaggacttaaacaaaaataacaaattacttggagacaggcaaagggcattgtgcaacattgccctcagtgccaggtagtacaactgccacgtgaaaggactggtgttaacccacagggattaacccccaatatgttgttgcaaaaggacctaacccatgtacctttgttcgggaaactttcatacgtccatgttactatagataccttttctcattttgtatgggcaacttgccaaacaggcgaggcggctgctcatattaagacattacttccctgtttcgctgccatgggcatcccacaaaagattaaaacaaacaatggcccaggctactgtagtaaatctttacaggcgttcctttaacagtggaacatcgagcacagtactggaataccctataattctcaaggtcaagccactgttgaacaggctaatcgaaccttaaaatctcaattacaaaaacaaaagacagagggggaaaccagagaatacgctactccttatatgcagctacaattggctcttatcacttcacattttctgaatttgtctagagatcacgttacaatggcagcagagcagcatttgacaaggcaaaaaataaatgcttatgaaggaaaacatgtgtggtggaaggacatcagaaccaaaacctgggaaaagggcaaaatcattacatggggtcgaggrttttcttgtatctcaccaggagagaatcagcttcctgtctgggtgcccacaagacatcttaagctgtgccatgagccagaatccaaggaagaggaaaagacctcggaacgtccctgcgcccccagttcgtcagacggctcagatgaacatctctgttgagcagatggaaaccagtaaaactcgccaagcaactccaccgacctgggggcagatgaagagactagctcacattgcagaagagaacctgaggtctcagaacaagctgctgaccaccagtaatctaatggtagctatgatggcggtaatctccttggcggtgagtctccccgtagctgaggcagatcaaaattacacttattgggcctacattccattcccaccactgattaggtctgttacatggttagaccccctggtggaggtttatgttaatgatagtatctggatgcctggaccaacagataaccgaggtcctactcatccagaggaggaaggaatgttaatgaatgtttccattggttatcgctttccttccatctgcctggggccagcagcaggatgtttaaattatgataaacaaatttggatggcttgtgtccctgcaaataatggatcaaaagcccctattcatgcaatcagtggaagaacatttcaatctttggacactattaaataccttgagcacggctatgttatgacacatcgccagattaataaatataaacctaataagaagccctgccctaggaaggccactaaatggtctggaaagctagaggtgctaacctgggaagattgtattgcaaacagcactgctgtactgcaaagtaattcctatggaatcgtcattgattgggcccctatgggacgctttgcagtaaattgtactggacagtgcgaagatggtagagagactccttttgcaaacgactacccagataatgcaccaaaattatatagaaaaattaaaacaaattaccctattaagtgggaggaaaacggtatggctctttcaagcccaaaaatgattgatccaattataagtccagaacatctagaattgtggaaattaatgatggctcaaaccccaattcggatttggaaaggagaatataaaacaaagacccttagtaaaaaacttcgatttgtcgtagccatgacctctaatcagacgttcccattgcagagttttgttaaacctcctcttatgttggcagtgggaaaaattaatatcctacctgactctcaaaccatatcatgcctcaactgtcatctttttacctgcgttaattctacctttaataaagataacagcattttaccggttagggcccaagtgggagtttgaatacctgtatccctcaatagaccttgggaggcctctccctccatacatattatcacggaagtactaaaaggaatacttaatagatcacagagattcatatttactttaatagctgtgatcatgggccttatagctgtcacagctactgctgctgctgctggtgttgctttgcactcttctattcaaactgcgggctttgtggatagttggcagaaaaattcttctaagctttggaattcccaaagccaaatagatcaaaaattggcaaatcaaattaatgatctctgtcaaacagtaatttggatgggagattggattatgaacttggagcatagaattcaaatgcaatgtgattggaatacttccgatttttgtattactcatagctcctataatgccattgaacaccagtgagagacgattagacgtcacctacaaggaaaaaaagataatttaacattagatattgctaaactgaaaaaacaagtttttgaggcatctcaggctcatctcaccctattgcctggagctgatattcttgctggagcctctgatggcctttctaataccaatcctttaaagtggattgaaaccataggtggatcaacaattgcaaattttattttggtttgtgtctgtttatgttgcttgtttttagtctacagatgcagatggtgccttgggagagaaaccagacaccatgaatgagccataatagcaatggcagttattaataaaaaaaaatcaatagaggcaaaaaaggggaaca

SEQ ID NO: 425 - DNA, 3285 bp, Homo sapiens
  repeat_region (1)..(3285): l1me_orf2
  misc_feature: n is a, c, g or t
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
atggcagacntaaancctaacatatcaatrmttacattaaatgtaaatggattaaacactccaatcaaaagatacagattgtcagagtggataaaaaaacaacacccaacaatatacwgcctatmagagacacaccttaaatataaagacacasataggttgaaartaaaagaatggaaaaagatataccatgcaaatwgtaaccaagagaaagccggagtggctatattaatatcagacaaagtagactttaaaccaagaaatattactagagataaagagggacatttcataatgataaaagggtcaatctatcagaaagacataacaatcctaaatatatatgcacccaanatcagagcaccaaaatacataaagcaaatactaatagaactgaaaagagaaatagacaaatccacaataatagttggagacttcaataccccactgtcagtaattgatagatcaactagacagaaaatcaataaggatatagaagacttgaacaacactatcaaccaactggacctaattgacatattatagaacactccacccaacaacagcagaatacacattcttytcaagtgcacatggaacattcaccaagatagaccatatgctrggccataaaacaagtctcaataaatttaaaaaaattgaaatyatacaaagtatgttctctgaccacaatggaataaaawtagaaatcaataacaaaaagatactctggaaaatncacaaatacttggaaattaaacaacatacttctaaataactcatgggtcaaagaagaaatcaaaagagaaattaaaaaatattttgaaataaatgaaaatgaaaayacaacatatcaaaaatttatgggatgcagctaaagcagtgcttagagggaaatttatagcattaaatgcctatattaaaaaagaagaaagatctcaaatcaataacctaagtttccaccttaagaaactagaaaaagaagagcaaattaaacccaaagtaagcagaagaaaggaaataataaagattagagcagaaataaatgaaatagaaaacagaaaaacaatagaaaaaatcaataaaaccaaaagttggttctttgaaaagataaaattgacaaacctttagctagactaaaaaaaagagagaagacacaaattactaatanatcagaaatgaaagaggagayattactacagatyctacagaaataaaaaggataataagagaatactatgaacaactttatgccaataaatttgataacctagatgaaatggacaaattccttgaaacacacaaactaccaaaactgactcaagaagaaatagaaaatctgaatagacctataactattaaagaaattgaatcagtaattaaaaaccttccaacaaagaaaagtccaggaccagatggcttcactggtgaattctaccaaacatttaaagaattaataccaatcctactcaaactcttccaaaaaatagaagaggagggaatacttcctaactcattctatgaggccagcattaccctgataccaaaaccagacaaagacattacaagaaaagaaaactacagaccaatatccctgatgaacatagatgcaaaaatcctcaacaaaatactagcaaancaaatccaacagcacatgaaaaggattatacaccatgaccaagtgggatttatcccagggatgcaaggctggtttaacatayaaaaatcaaycaatgtgatwcactacatyaacagrntaaaggagaaaaatcatatgatcatctcaatagatgcagaaaaagcatttgacaaaattcaacatccattcatgataaaaactctcaataaactaggaatagaaaggaacttcctcaanataataaaggnmatatatgacaaacctacagctaacatcatacttaatggtgaaaaactgaaagcwtttcccctaagatcaggaanaagacaaggatgtctactctcaccatttctattcaacattgtactggaagtcctagccagtgcaataaggcaagagaaagaaataaaaggcatacagattggaaaggaagaagtaaaactgtctttattkgcagatgacatgattttntatatagaaaatyctaaagaatccacaaaaaaacwactagaactaataaataaatttagcaagntcncaggatacaaggtcaatatacaaaaatcaattgtatttctatatactagcaacgaacaatntgaaaatgaaattaagaaaacaatwccatttacaatagcatcaaaaaaataaaatacttaggaataaatttaacaaaatayatrcaagacttgtacgctgaaaactacaaaacattgatgaaagaaattwaagaagacctaaataaatggagagatataccatgttcatggattggaagactcaatattgttaagatgkcaatactccccaaattgatctatagattcaatacaatcccaatcaaaatcccaatggttttttttgtagaaattgacaarctgattctaaaatttatatggaaatgcaaaggatccagaatagccaaaacaattttgagaaagaagaacaaagttggaggactcacattacctgatttcaaaacttactayaaagctacagtaatcaagacagtgtggtattggtataaggatagacatatagatcaatggaacagaatagagaacccagaaatagacccacacatatatggtcaaytaatttttgacaaaggtgccaaggcaattcaatggggaaagaatagtcttttcaacaaatggtgctggaacaactggatatccatatgcaaaaaaatgaasttmgacccctacctcacaccatatacaaaaattaactcaaaatggatyatagacctaaatgtaaaanctaaaactataaaactyttagaagaaaacataggagaaaatcttcgtgaccttgggytaggcaawgatttcttagatatgacacmaaaagcacaagcaacaaaaggaaaaattgataaattggacttcatcaaaattaaaaacttctgctcttcaaaagacacyatcaagaaaatgaaaagacaagccacagactgggagaaaatatttgcaaawcatatatctgacaaaggacttgtatccagaatatataaagaactcttacaactcaataataaaaagacaaataacccaattaaaaaatgggcaaaggayttgaacagacatttcwccagagaagatatacaaatggccaataagcacatgaaaagatgctcaacatca

SEQ ID NO: 426 - DNA, 1708 bp, Homo sapiens
  repeat_region (1)..(1708): ricksha_0
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
gggtttggatcataatcccaaaagacacaatcccaaacgccataatcccgaatgttgaaatcccgaaagatcaaaatccctaaagtctaaaatccctaaagtctaaaatcccaaaaattcacacaggatggttgcatcatgttaggcagaactgttattttcttattgtctttatgcagaaaaaatggattttaattgaatccccaaaccataatgacagatttggaattaggtgcgatcaaggcttctaaaagtgaatttcaaggtgttaccaataaagtttgtttttttccattcagcccaatgcatttggtggaaaattcagatgagtggattggccatgcgatacggcaacgacgaaaacttcagtttaaaaatgcgtcatttgcctgcattggcattccttccagctgatgacattccgggagcttttaatgaattaaagccgcatttgcctgaagaagtcagcgaagttactgactggttcgaaaataattatgtgcacggtaggataagaagacacttacacaacggtgttgccgttcgattaccagtattgtttctaccaaatttgtggtctgtatatgagtgcatgcagaatggatttctatatacccaaaacaacatagaagcatggcacagaagatgggaaaatttaatagggaatgctcatgtcggtgtatatcgaatcagaagattcaaaaagagcagcgccacgtagaaaatgaatgtgaacatattctccgaggagagccatgtcctaaaagaaaaaaaaaagcagctattcatcgcgatgcaagacttcaaaatatagttaatgatcgtgaaagtcggccagctcttatggactatctccgtgcaattgcccataatctatccctgtaatatactttttcatatgtcgaattttctttttagttttttttcactattttaaattgtcagcattattttttacaattcgctatgctatgtatttcatcttcgcatcatttccaatactggaggtataaattgtgtaaagacttttagagagttctaattcgttttatgcattttttgcaaatttgactccacgaaagtgcattatcacaacgttgactttgtgtgtaagcattgtgcgtgtacgtaaaaacgttgaaacttcctcaataaatgaagagatgtcctttttgtacatctgcatttgtgaaagataaaatttctcgagatctcggctctttgggcgactgcatatgcagtggtgacccatcgcggtttttgatcgatctcgtcaaaagacttaggttgttcgtcacggtatttcagatgaccgcagttataaagctgggtgcacacaattaccaaccatagtgatatgcgtttatacatttccctttttgacctatttctttatgaatacggttcgtctgctcataactgttatacccgtgcgactgtcattagtatacctgagtgtttatgcttgcaaaaatatgtatgttattattgcctattttattgtgtaaagtggcctatgaagtgttctgtcatgtttttatatgtttctcaaataaatccccttttaaaaatgtaaataaatatcttttaaaaaatttttaaattattttttccagaattatatttttgggattttgatctttcgggatttcaacattcgggattatggcgttcgggattgtgtctttcgggattatgatcggctccc

SEQ ID NO: 427 - DNA, 351 bp, Homo sapiens
  repeat_region (1)..(351): tigger5_a
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagatgctcctcgacttacgatggggttacatcccgataaacccatcgtaagttgaaaatattgtaagtcgaaaatgcatttaatacacctaacctaccgaacatcatagcttagcctagcctaccttaaacatgctcagaacacttacattagcctacagttgggcaaaatcatctaacacaaagcctattttataataaagtgttgaatatctcatgtaatttaytgaatactgtactgaaagtraraaacagtatggttgtatgggtacttgaagtacggtttctactgaatgtgtatcgctttcgcaccatcgtaaagttgaaaaatcgtaagttggggaccatctg

SEQ ID NO: 428 - DNA, 446 bp, Homo sapiens
  repeat_region (1)..(446): tigger5_b
  ref <301>: AUTHORS: Jurka, J; Walichiewicz, J; Milosavljevic, A
  ref <302>: TITLE: Prototypic sequences for human repetitive DNA
  ref <303>: JOURNAL: Journal of Molecular Evolution
  ref <304>: VOLUME: 35
  ref <305>: ISSUE: 4
  ref <306>: PAGES: 286-291
  ref <307>: DATE: 1992-10-__
  ref <308>: DATABASE ACCESSION NUMBER: Database of repetitive elements (repbase)
  ref <309>: DATABASE ENTRY DATE: ____-__-__
  ref <309>: DATABASE ENTRY DATE: 1996-01-26
cagatgctcctcgacttacgatggggttacatcccgataaacccatcgtaagttgaaaatattgtaagtcgaaaatgcatttaatacacctaacctaccgaacatcatagcttagcctagcctaccttaaacatgctcagaacacttacattagcctacagttgggcaaaatcatctaacacaaagcctattttataataaagtgttgaatatctcatgtaatttactgaayayartacactgtagartayyggttgtttaccctcgtgatcgcgcggctgactgggarctgcggytcactgycgctgcccagcatcgcgacagagtattgtaccgcatatcgcyagcctgggaaaagatcagaaattcgaagtacggtttctactgaatgcgtatcgctttcgcaccatcgtaaagttgaaaaatcgtaagttgggaaccatctg

SEQ ID NO: 429 - DNA, 30 bp, Homo sapiens
  misc_feature (1)..(30): oligonucleotide HIRA genomic sequence (positions 853946-853975)
  ref <308>: DATABASE ACCESSION NUMBER: GenBank/NT_001039
cctacccttttcccgccccatttccaaccc

SEQ ID NO: 430 - DNA, 32 bp, Homo sapiens
  misc_feature (1)..(32): oligonucleotide HIRA genomic sequence (positions 859116-859085)
  ref <308>: DATABASE ACCESSION NUMBER: GenBank/NT_001039
tgttcccctcaccttcctaactcagtgccctc

SEQ ID NO: 431 - DNA, 33 bp, Homo sapiens
  misc_feature (1)..(33): oligonucleotide for HIRA genomic sequence (postions 819901-819933)
  ref <308>: DATABASE ACCESSION NUMBER: GenBank/NT_001039
ccgtcttttgtcttcacaaccaagcccagagcc

SEQ ID NO: 432 - DNA, 34 bp, Homo sapiens
  misc_feature (1)..(34): oligonucleotide for HIRA genomic sequence (positions 823592-823559)
  ref <308>: DATABASE ACCESSION NUMBER: GenBank/NT_001039
cactgcctgctcccccaaattgcaaaatgttgtc

SEQ ID NO: 433 - DNA, 30 bp, Homo sapiens
  ref <308>: DATABASE ACCESSION NUMBER: GenBank/NT_001039
gtacttggctgatggtggcacaggctaggg

SEQ ID NO: 434 - DNA, 32 bp, Homo sapiens
  misc_feature (1)..(32): oligonucleotide for HIRA genomic sequence (positions 846946-84691 5
  ref <308>: DATABASE ACCESSION NUMBER: GenBank/NT_001039
actggatgtggcacctgactttcaaggctgac

SEQ ID NO: 435 - DNA, 32 bp, Homo sapiens
  misc_feature (1)..(32): oligonucleotide for HIRA genomic sequence (positions 875226-87525 7
  ref <308>: DATABASE ACCESSION NUMBER: GenBank/NT_001039
tggctttgacatctgaggcagagaaaccacgc

SEQ ID NO: 436 - DNA, 33 bp, Homo sapiens
  misc_feature (1)..(33): oligonucleotide for HIRA genomic sequence (positions 878074-87804 2
  ref <308>: DATABASE ACCESSION NUMBER: GenBank/NT_001039
gccgagcaatacatcaactcatgaccacgggag

SEQ ID NO: 437 - DNA, 35 bp, Homo sapiens
  misc_feature (1)..(35): oligonucleotide from PAC clone containing Necdin gene (positions 72122-72156)
  ref <308>: DATABASE ACCESSION NUMBER: GenBank/AC006596
ctcctcaagtgtcttcccagctacctcccagtttc

SEQ ID NO: 438 - DNA, 30 bp, Homo sapiens
  misc_feature (1)..(30): oligonucleotide from PAC clone containing Necdin gene (positions 75666-75637)
  ref <308>: DATABASE ACCESSION NUMBER: GenBank/AC006596
cagagccagcccccaccttaagtatggcac

SEQ ID NO: 439 - DNA, 35 bp, Homo sapiens
  misc_feature (1)..(35): oligonucleotide from PAC clone containing Necdin gene (Positions 94501-94535
  ref <308>: DATABASE ACCESSION NUMBER: GenBank/AC006596
accctctgattcaggaaaggggtgcatacatggtc

SEQ ID NO: 440 - DNA, 35 bp, Homo sapiens
  misc_feature (1)..(35): oligonucleotide from PAC clone containing Necdin gene (positions 98601-98667
  ref <308>: DATABASE ACCESSION NUMBER: GenBank/AC006596
ctttcacaccgtcacccagtcacatacaccaacac

SEQ ID NO: 441 - DNA, 32 bp, Homo sapiens
  misc_feature (1)..(32): oligonucleotide from PAC clone containing Necdin gene (Positions 76608-76639)
  ref <308>: DATABASE ACCESSION NUMBER: GenBank/AC006596
gcctggaaatcaatgcagccaactctgtcttc

SEQ ID NO: 442 - DNA, 31 bp, Homo sapiens
  misc_feature (1)..(31): oligonucleotide from PAC clone containing Necdin gene (positions 78898-78867
  ref <308>: DATABASE ACCESSION NUMBER: GenBank/AC006596
ggcatgatactcagtgaaagacgccagtctc

SEQ ID NO: 443 - DNA, 30 bp, Homo sapiens
  misc_feature (1)..(30): oligonucleotide primer for CDC2L1 gene coordinates 13960-13931
  ref <308>: DATABASE ACCESSION NUMBER: GenBank/AL031282
cccccacccacatctccttgcagaagatcc

SEQ ID NO: 444 - DNA, 30 bp, Homo sapiens
  misc_feature (1)..(30): oligonucleotide primer sequence for CDC2L1 gene (positions 9137-9 167
  ref <308>: DATABASE ACCESSION NUMBER: GenBank/AL031282
cctcggtttaccacctgccttggctccttg

SEQ ID NO: 445 - DNA, 30 bp, Homo sapiens
  misc_feature (1)..(30): oligonucleotide primer for CDC2L1 gene (positions 13028-13057)
agctgcgacttctgctacggtgatgcccac

SEQ ID NO: 446 - DNA, 33 bp, Homo sapiens
  misc_feature (1)..(33): oligonucleotide primer for CDC2L1 gene (positions 17753-17720)
  ref <308>: DATABASE ACCESSION NUMBER: GenBank/AL031282
ggctgggatggccttttgttcacactggttttg

SEQ ID NO: 447 - DNA, 69 bp, Artificial
  Description of Artificial Sequence: repetitive sequence found in many eutherial genomes. Length of core repeating element is varia ble and is often polymorphi
aaaaaaaaaaaaaaaaaaaaaaaaaaaaaaaaaaaaaaaaaaaaaaaaaaaaaaaaaaaaaaaaaaaaa

SEQ ID NO: 448 - DNA, 69 bp, Artificial
  Description of Artificial Sequence: repetitive sequence found in many eutherial genomes. Length of core repeating element is varia ble and is often polymorphi
ccccccccccccccccccccccccccccccccccccccccccccccccccccccccccccccccccccc

SEQ ID NO: 449 - DNA, 69 bp, Artificial
  Description of Artificial Sequence: repetitive sequence found in many eutherial genomes. Length of core repeating element is varia ble and is often polymorphi
agagagagagagagagagagagagagagagagagagagagagagagagagagagagagagagagagaga

SEQ ID NO: 450 - DNA, 69 bp, Artificial
  Description of Artificial Sequence: repetitive sequence found in many eutherial genomes. Length of core repeating element is varia ble and is often polymorphi
acacacacacacacacacacacacacacacacacacacacacacacacacacacacacacacacacaca

SEQ ID NO: 451 - DNA, 69 bp, Artificial
  Description of Artificial Sequence: repetitive sequence found in many eutherial genomes. Length of core repeating element is varia ble and is often polymorphi
caacaacaacaacaacaacaacaacaacaacaacaacaacaacaacaacaacaacaacaacaacaacaa

SEQ ID NO: 452 - DNA, 69 bp, Artificial
  Description of Artificial Sequence: repetitive sequence found in many eutherial genomes. Length of core repeating element is varia ble and is often polymorphi
caaacaaacaaacaaacaaacaaacaaacaaacaaacaaacaaacaaacaaacaaacaaacaaacaaac

SEQ ID NO: 453 - DNA, 69 bp, Artificial
  Description of Artificial Sequence: repetitive sequence found in many eutherial genomes. Length of core repeating element is varia ble and is often polymorphi
tcatcatcatcatcatcatcatcatcatcatcatcatcatcatcatcatcatcatcatcatcatcatca

SEQ ID NO: 454 - DNA, 69 bp, Artificial
  Description of Artificial Sequence: repetitive sequence found in many eutherial genomes. Length of core repeating element is varia ble and is often polymorphi
ccaccaccaccaccaccaccaccaccaccaccaccaccaccaccaccaccaccaccaccaccaccacca

SEQ ID NO: 455 - DNA, 69 bp, Artificial
  Description of Artificial Sequence: repetitive sequence found in many eutherial genomes. Length of core repeating element is varia ble and is often polymorphi
cctacctacctacctacctacctacctacctacctacctacctacctacctacctacctacctacctac

SEQ ID NO: 456 - DNA, 69 bp, Artificial
  Description of Artificial Sequence: repetitive sequence found in many eutherial genomes. Length of core repeating element is varia ble and is often polymorphi
cgcgcgcgcgcgcgcgcgcgcgcgcgcgcgcgcgcgcgcgcgcgcgcgcgcgcgcgcgcgcgcgcgcgc

SEQ ID NO: 457 - DNA, 69 bp, Artificial
  Description of Artificial Sequence: repetitive sequence found in many eutherial genomes. Length of core repeating element is varia ble and is often polymorphi
cgaacgaacgaacgaacgaacgaacgaacgaacgaacgaacgaacgaacgaacgaacgaacgaacgaac

SEQ ID NO: 458 - DNA, 69 bp, Artificial
  Description of Artificial Sequence: repetitive sequence found in many eutherial genomes. Length of core repeating element is varia ble and is often polymorphi
cggacggacggacggacggacggacggacggacggacggacggacggacggacggacggacggacggac

SEQ ID NO: 459 - DNA, 69 bp, Artificial
  Description of Artificial Sequence: repetitive sequence found in many eutherial genomes. Length of core repeating element is varia ble and is often polymorphi
gaagaagaagaagaagaagaagaagaagaagaagaagaagaagaagaagaagaagaagaagaagaagaa

SEQ ID NO: 460 - DNA, 69 bp, Artificial
  Description of Artificial Sequence: repetitive sequence found in many eutherial genomes. Length of core repeating element is varia ble and is often polymorphi
gaaagaaagaaagaaagaaagaaagaaagaaagaaagaaagaaagaaagaaagaaagaaagaaagaaag

SEQ ID NO: 461 - DNA, 69 bp, Artificial
  Description of Artificial Sequence: repetitive sequence found in many eutherial genomes. Length of core repeating element is varia ble and is often polymorphi
gacagacagacagacagacagacagacagacagacagacagacagacagacagacagacagacagacag

SEQ ID NO: 462 - DNA, 69 bp, Artificial
  Description of Artificial Sequence: repetitive sequence found in many eutherial genomes. Length of core repeating element is varia ble and is often polymorphi
ggaggaggaggaggaggaggaggaggaggaggaggaggaggaggaggaggaggaggaggaggaggagga

SEQ ID NO: 463 - DNA, 69 bp, Artificial
  Description of Artificial Sequence: repetitive sequence found in many eutherial genomes. Length of core repeating element is vari able and is often polymorphi
gcagcagcagcagcagcagcagcagcagcagcagcagcagcagcagcagcagcagcagcagcagcagca

SEQ ID NO: 464 - DNA, 69 bp, Artificial
  Description of Artificial Sequence: repetitive sequence found in many eutherial genomes. Length of core repeating element is varia ble and is often polymorphi
gccgccgccgccgccgccgccgccgccgccgccgccgccgccgccgccgccgccgccgccgccgccgcc

SEQ ID NO: 465 - DNA, 69 bp, Artificial
  Description of Artificial Sequence: repetitive sequence found in many eutherial genomes. Length of core repeating element is varia ble and is often polymorphi
gccagccagccagccagccagccagccagccagccagccagccagccagccagccagccagccagccag

SEQ ID NO: 466 - DNA, 69 bp, Artificial
  Description of Artificial Sequence: repetitive sequence found in many eutherial genomes. Length of core repeating element is varia ble and is often polymorphic
gcccgcccgcccgcccgcccgcccgcccgcccgcccgcccgcccgcccgcccgcccgcccgcccgcccg

SEQ ID NO: 467 - DNA, 69 bp, Artificial
  Description of Artificial Sequence: repetitive sequence found in many eutherial genomes. Length of core repeating element is varia ble and is often polymorphi
ggaaggaaggaaggaaggaaggaaggaaggaaggaaggaaggaaggaaggaaggaaggaaggaaggaag

SEQ ID NO: 468 - DNA, 69 bp, Artificial
  Description of Artificial Sequence: repetitive sequence found in many eutherial genomes. Length of core repeating element is varia ble and is often polymorphi
ggcaggcaggcaggcaggcaggcaggcaggcaggcaggcaggcaggcaggcaggcaggcaggcaggcag

SEQ ID NO: 469 - DNA, 69 bp, Artificial
  Description of Artificial Sequence: repetitive sequence found in many eutherial genomes. Length of core repeating element is varia ble and is often polymorphi
gggagggagggagggagggagggagggagggagggagggagggagggagggagggagggagggagggag

SEQ ID NO: 470 - DNA, 69 bp, Artificial
  Description of Artificial Sequence: repetitive sequence found in many eutherial genomes. Length of core repeating element is varia ble and is often polymorphi
atatatatatatatatatatatatatatatatatatatatatatatatatatatatatatatatatata

SEQ ID NO: 471 - DNA, 69 bp, Artificial
  Description of Artificial Sequence: repetitive sequence found in many eutherial genomes. Length of core repeating element is varia ble and is often polymorphi
taataataataataataataataataataataataataataataataataataataataataataataa

SEQ ID NO: 472 - DNA, 69 bp, Artificial
  Description of Artificial Sequence: repetitive sequence found in many eutherial genomes. Length of core repeating element is varia ble and is often polymorphi
taaataaataaataaataaataaataaataaataaataaataaataaataaataaataaataaataaat

SEQ ID NO: 473 - DNA, 69 bp, Artificial
  Description of Artificial Sequence: repetitive sequence found in many eutherial genomes. Length of core repeating element is varia ble and is often polymorphi
ctactactactactactactactactactactactactactactactactactactactactactacta

SEQ ID NO: 474 - DNA, 69 bp, Artificial
  Description of Artificial Sequence: repetitive sequence found in many eutherial genomes. Length of core repeating element is varia ble and is often polymorphi
tacatacatacatacatacatacatacatacatacatacatacatacatacatacatacatacatacat

SEQ ID NO: 475 - DNA, 69 bp, Artificial
  Description of Artificial Sequence: repetitive sequence found in many eutherial genomes. Length of core repeating element is varia ble and is often polymorphi
tagatagatagatagatagatagatagatagatagatagatagatagatagatagatagatagatagat

SEQ ID NO: 476 - DNA, 69 bp, Artificial
  Description of Artificial Sequence: repetitive sequence found in many eutherial genomes. Length of core repeating element is varia ble and is often polymorphi
tcaatcaatcaatcaatcaatcaatcaatcaatcaatcaatcaatcaatcaatcaatcaatcaatcaat

SEQ ID NO: 477 - DNA, 69 bp, Artificial
  Description of Artificial Sequence: repetitive sequence found in many eutherial genomes. Length of core repeating element is varia ble and is often polymorphi
tccatccatccatccatccatccatccatccatccatccatccatccatccatccatccatccatccat

SEQ ID NO: 478 - DNA, 69 bp, Artificial
  Description of Artificial Sequence: repetitive sequence found in many eutherial genomes. Length of core repeating element is varia ble and is often polymorphi
tgaatgaatgaatgaatgaatgaatgaatgaatgaatgaatgaatgaatgaatgaatgaatgaatgaat

SEQ ID NO: 479 - DNA, 69 bp, Artificial
  Description of Artificial Sequence: repetitive sequence found in many eutherial genomes. Length of core repeating element is varia ble and is often polymorphi
ttaattaattaattaattaattaattaattaattaattaattaattaattaattaattaattaattaat

We claim:

1. A method of developing a hybridization probe for a target nucleic acid sequence, said method comprising the steps of:
    determining the sequence of at least one single copy sequence in said target nucleic acid sequence computationally, said determining step comprising the steps of ascertaining the nucleotide-by-nucleotide sequence of said target nucleic acid sequence, comparing said ascertained sequences with the sequences of SEQ ID Nos. 1–428 and 447–479 in said target nucleic acid sequence using a computer program, and identifying said single copy sequence from said comparison; and
    developing a hybridization probe comprising a sequence complementary to a non-repetitive portion of the target which hybridizes to at least a part of said identified single copy sequence.

2. The method of claim 1, said probe developing step comprising the steps of obtaining at least a part of said single copy sequence, and purifying said part of said single copy sequence.

3. The method of claim 2, said purifying step comprising carrying out PCR.

4. The method of claim 1, including the step of labeling said hybridization probe.

5. The method of claim 1, target nucleic acid sequence and said probe being DNA.

6. The method of claim 1, said hybridization probe having at least about 80% sequence identity with said single copy sequence.

7. A method of identifying a single copy sequence interval from a target nucleic acid sequence, said method comprising the steps of ascertaining the nucleotide-by-nucleotide sequence of said target nucleic acid sequence, comparing said ascertained sequences with the sequences of SEQ ID Nos. 1–428 and 447–479 in said target nucleic acid sequence using a computer program, and identifying said single copy sequence from said comparison.

8. The method of claim 7, wherein said nucleotide-by-nucleotide sequence of said target sequence is obtained from existing database information.

* * * * *